United States Patent 12,576,115 (BACTERIAL COMPOSITIONS FOR TREATING AND PREVENTING HALITOSIS) - sequence listing, part 8

SEQ ID NO: 21 - DNA, 1845644 bp, unidentified
  source 1..1845644: mol_type = genomic DNA; note = Latilactobacillus curvatus
ttctcaaagaaattggcttagcttatttacaccttggtgaaagtacaccgagtctttcgggtggcgaagcacagcgcttaaaactcgcaacgcatttgaataaaaaacgggcgggcactttattcgtcttcgatgaaccttctgttggcttgcatccgcgcgatgttgaaaccttagtaggcgtcatcaaccagctaaaatccaagggtgccaccattatgatgattacccacgaccttgatttgatgaccaatgccgattacctgatcgacttggggcctaaaggtggtagtcaagggggccaagtgatggcgatgggtgcaccatttgagcttgttgcctcagacgcggagagtttaaccttaagttatttacgggcacattttaagaagtttcaattaacaacaactaaagtggggtgaaaaaatgggacaaacctctttgtttgatcaagagatggcgatgaatgcgccgcttgctaatcgggtccgaccgtctgatttagacagttttgtcggtcagaagcatttagtcggaccaggcaagtttttacgcgaaatgattgataaagatcaagtgacttcgatgattttctggggaccacccggcgttgggaagaccacgttggcggagattatcgcgcgcaagacggcttcgaaatttatcacgtttagtgccgcgatgaatgggatcaaagagattcggaagattatgaatgaagccgaagaaaaccgccaactgggtgagcggacgattgtctttattgatgaaattcaccggtttaacaaggcgcaacaggatgcttttttaccgtatgttgaaaaaggcagcattatcctaattggtgcgacaaccgaaaatccgtcgtttgaaatcaattcagcgttgctgtcgcgttcacgcgtttttgtgctaaagcaattgacggaagcagacattattgagttgctacaacgggttttaaaggcgccccaagccttcccggatttaacggttcatatcagtgatgaattattgaagcaagtcgccatcttttcgaatggggatgcacggacggcgctgaatattttagaaatgttagttattaatagtgatgtgcaagaccatcaagtgaccgtcgatggcgatctattgggggaactgctaaataaaaaaaccgcctattatgataaagacggtgaggaacactataatattatttcggctttgcataagtcgatgcgcaatagtgatgtcgactcagcgatttattggttggggcggatgattgacggtggcgaagacccgatttatattgctcggcggctcgttcgttttgcgagtgaggacattggtctggccgataacaatgcattgaatttagcaatgaacgtctttcaagcttgtcaggcgattggcttaccggaatgcgacgtgcatttaacacagtgcgtgatttatctatcgcttgcgccgaaatcaaacgccacttataaggcgcggacagcggtgcaaaaggatattaaaaagacgattgatgaacccgtgccattgcacttacgtaatgcggcgacgaaattgatgaaggaagtcggttacggcaaaggatatcaacttgcacatttctacgatgatagattgaccacgatgccaactagaccagagagtatcgccgaccatatttattaccggccgaccgaacaaggcaatgaaacgcggatgaaacaacgtttgaattacattaatgaatggaaacaaaagcacaatactgattttcaagataaataaaaagtcgcagtcatttgactacgactttttaaattaagcttcttttgccactggacgccagaggcctaagattagggcactgacaaatgttccgattaacacggcaagcacaaagagtaggccgtggttggcaagtggtgccacgaagatcccaccatgtggtgcagggacagtgatttgccataattgggttaaaccaccaccgattgctgaaccgataacacttgaaacaatcacgtgtaatggatctgatgcagcaaatggaatggcaccttcagtaatgaatgaaatccctaatacatagtttgcgaaggcttgtttccgttcactaccggtaaatttgtttttgaaaatagtagcagcaaccgcgattgccaatggtgggaccatcccaccagccatgacagcggccatcaatgaaccatctttggtggttgtgaagacaccgattgcgaaggtataagcagccttgttgaaaggaccgcccatatcaacggacatcatgccacctaaaatcgcaccaagtagtaatgcgttaccagcccctaagtgtgttaagaaggtactcaaccagaggttaatttgagcaaagactgggttgatcatgaagtacataataaagccaacaatcaatagtcctaatacagggaatattaagattggttttaaaccatcaagggtttgtggcaagttcttgaagactttcttcaaaccaacgatcacccaaccagcgatgaacccagcagctaaaccgccaaggaatccggctggactctttgaagcaaggacactggctgttgcttggctagccatgtagcccccgacaaatccgggcattaaggcaggccgatcaccgattgaaatcgcgatgtaagcagcaaggaccggaattaagaagttaaaggcattattgcctaatgagttcaagaaaataaaagtggttgaatgtgcgccaacggtttgttccaaaaggaatgagatggccatcaagatcccaccaccgacaacgaatggtaacatgtttgaaacaccattcattaaatcttggtagatgcgactccaaagggttttcttgtcagctgaagcttcttcgcttgattggctttcagttgcgtgatagattgagccttcttcatccaatgttttttgaatcaattcagctggtttcttgatgccgtcgatcacgggacggttcaagagatgtttaccatcaaaacgaggcatatcgactttcttgtcggcagcgatgataacccctgttgcgcggttaatatcgtcagcggttaattggtgtttaacgccttcagaaccgtttgtttcaactttaatgtcgatgcccattttagcagctgtttctttcaaggcagcttcggccatgtaagtgtgggcaatcccagttgggcaggctgtgacagcaacgatgaatggtttttgatcatcagctggcgttgcggctgcggcttgtgctttagcggcttcttcagcttcttccttcgcatcttctgcgtctttagcagcttgagccttagcaaagagcgtttgcacgccttctggtgtttgggcttgtttcaaatcagcgactaattgtgggttgattaaaagggatgaaagaccagccaaggcttgtaaatgcgtatcgttagcgccttctggagcggcaatcatgaagaacaagtaaacgggttggccgtctagtgcgtcatattcaacaccgttttgacttttagcgaatagcacagttgcgcgttgaacggcactgtcttttgcatggggcattgcaatcccttcgccaattccagttgatgattgggcttcacgagccaaaatatctttacgatagagggcgtcatctgtgataacaccgatgtctttatagcgggcaaccatttcatcaacagcggcttctttagtcgttgcttgtaaatccatgatcatcgcatcttttaagagtaaatcttggatgttcataataaatctcctttgtatttaaaattaatcaacttgtgtgatttcaatttgaggtaagagttcgttaatcttagcgctagtggctaaatcttcagaaaaggcggtggcactaccacaagcaagacttgttttaaaagcggcgagtgcatcgtgatgttgtgcgaatgtgccgacaaaaccggcgatcattgaatcaccagccccaacggaattaatcactgtccctttaggtgtaccaccgaggtaagcgtggtctggtgtgattaaaagggcaccgtcaccggccattgagaccaagacatgttgggcaccttggtctaataatttgcgaccagcggcgatgatttcactttggttggcaaagtgtgtgtcgaacagttcggccaattcgtgatggttgggtttgatgaccaatggtttttcagccaatgtgtctaacaaagcttgaccggttgtatcaattacaaattcagcgttgtgcgcttgaatcaatgggattaagtctttgtagaaactagccggtaaattaggtggcaaactcccagacatgaagacaatatcgccggcttccagcttagccagttgttgtttcaagttggcaacggcttctgctgaaatgtgtgggccttgaccgttaatttcagtttcttcagtattgtcttttaacttcacgttaatccgggtgtcttcttcgacttcagtgaatcgacagtcgatcgaagcgttgttgagtttgctttgaatgaattgaccagtgaagccaccgacaaagccgagggcaacgcttggtaatgctaattcggcaaggatgcgtgaaacgttaatccctttaccaccggggagcttaacgtcagattggacgcggttcacgttaccggtatttagtttttcaagttgaatgacgtaatcgattgatggattcgccgtaatcgtataaatcaagataaaacctcctggatttctgtgtgtgaatgatagtgtttgtaaacagatggtgacaattgatcagtaatcaattggacttgtgccaatggggcaaacttactgaacgaaacagcgtcgaattttgtgtgatccgccaaaaccatcgtttggttcgcttgttgaatcgcaaagcgctttagagtggcttcttctggatcaggggtggttagcccagcttcaacatcgataccgtttgtgccaagaatcgcctgattgaattggaattgcaaaagggtttctaaagcagccgcaccgaccatcgctttggttttgctcttaacacgcccacctaatagaaaggtttgaatttggtgatcggctaagagagaagcggtatcaaccccattggtgacgaccgtcaaattcatttcaggtcttaagtaggggatgattgcctgggtcgttgtgccggcatctaagtaaatgacgcagccttgttggatttgtgctgcggcaaacttagcaatcgcgtttttttcatgaacgttcttgccgtttttttcaatctggccaagttcttcttgtaacgtgttgatgcgcttagcaccaccgtgaattcgagtagcaagcccttgttcttcgagcaattgcaagtcacgacggacagttgattcagaagcgttcaataactggcacaaagattgcatcttaacgacgtcttgttgctttaaaagttgtaatatcgcttggtgacgttcttctgttaacatgacaaaacctccgtagcatcattatgacatcgtttccattcaaaagcaatcgaaatatttcaaaaacgttcaaaaaccatcaaaacgctgatatagaccaaaaaaaagattggtgcgttagtgagcaaactgcggacaatgccagaaatagaccagtttaaaagtaatgtaagagttttcaaaagtgcttaaggtatgctagactaatagatgacagggtggtatagcccaattattaggaggttctattcatgggaaaactaggcgtttcaatttatccagaacgatcaacttttgaaaaggatgcggcttacttagatttagcgcatcaatatgggttccaacgcgtctttacatcattattggaggtgtctggcgatcaagaagccgtgttaggcaactttaaacgggttgtagcccatgccaaccaattaggaatgcaagtcatgattgatatcaatccgggtttgttcaagcaactcggtatttcatatgataatttaagttttttccatgaacttggtgcttggggaattcggttggacaacggttttaccggccaagaagaagcggaaatgacgcgcaatccgtttaatttaaaaattgaaattaatatgagtcaagggacaagttacgttgataacattatgagttattcacccaaacgggaaaacttgttaggctgtcataacttctatccacatcggttctcaggattaggtgaagacttcttcaaacaatgtacggcgcaatttgcaaaatacaatttgaatacagcagcgtttgtcaattcacatgaagcaactttcggaccatggccaacacaagatgggttgcccacgatggaagttgatcgcgatttaacgatggcaacgcagatgaaacattacgttttaatggataacattgatgacattattgtcggtaatgcgtatgcttcggaagcagaattgaagacgatgcatgacgtctttaacgctgaattcccagcaatcgcaatcgacgtcgcagatgacattacggctgatgaacgcaaggtcctctttgaaagtctgcatagttatcgtggcgatcgttcagaatatcttctacggtcaacgatgacacgggtcatttttaaagacctgcctttcccagcccaccatacagttgacatccaacacggtgatattttaatcgataacgtcggttacggtcagtataaaggggaaacccaaattgccctcaaagccatgccaaatgacgggcgcgtgaatgtggttggccgtattacgcctacagaattattcctattagactatttgaaaccatggagccaatttaaattggtgccagctagccattaattaacgaataaaaagcgtactgattgaggtcactcactcagtgcgctttttatcgatgatagagccaattcagtgtttaaccagttatctgtttacttttaatctttttttcggtagtatataaggtactgtttaacgatgagaaggagtcaaaatatgtttgtagatcaagtcaaaattgatgtgaaagctggtaaaggcggcgatggtgcagttgcatttcgccgtgaaaagtttgtgccacttggcggaccagccggtggcgatggtggtcggggcggaagtgtcattttagtggtagatgaaggtctacgaacattaatggactttcgttaccgtcatcactttaaagccaatagtggtggtaatggtcagaataaacaaatgtacggccgcggtgccgaggatacatttgttcaagtgccacctggtacaacggtgcgcgatgctgaaaccaatgaattactcggtgatttaaccgaagatggccaacaattagtgattgctaagggcggtcgtggtggtcgtgggaatatgcatttcgcaaatgcccgtaatagtgcgccggaagttgccgaaaacggtgaacctggtgaagaacgcagcattcaacttgaattaaaagtgcttgctgatgttgggttggttggtttcccatctgttgggaaatcaacgttgttgtcagtggtgacaagtgcgaaacctaagattgctagttaccaatttacaacgttggtccctaacttagggatggtgcaactcgatgacggtcgggactttgtcttagccgatttaccggggttaatcgaaggggcttcagacggtgttggtttagggattcaattcttacggcacgttgaacgaacacgggttgtcttgcatttaatcgaaatggacgatcaaacgggtcgcgacccatttgaagattaccaacaaattaatcacgaattagagacctatgatccaaaaatcttagaacgaccacaagtgattgtagcgactaagatggatttaccaggttcttctgaattattagccgagtttaaacaaaaattagcagctgccggcgatacacatgagatttttgaaatttcaagtatcacgcatcaaggggtgcaaccattgatgaacaagacagctgacttattagctgaaacgactgaattcccaatgggagacgtcgaagaagttcaaacgcaaaaactttatcaatatcaaccggaagcacctgctttcatcattgaacaagatgaatacggcacgtttattgtgtctggtgacaaggttgaaaaactcttcaagatgagtaacttggatcatcaagatggtgtcatgcgttttgcccgtcaattacgttcaatggggattgacgaagccttacgcgaaagtggcgcacatgatggtgatttagtggcaattgataactttacgtttgaatttgtcgaataatagggcacgtcaagaaaggaagacattcatttttgaatgcttcctttttctatgggatgcataaaataacagggcttaatgtaggcacatcactaaaatattgttataatagcagttattagaatgtagagtaggttgaaaaaatggcgggcaagaagcgtttaaagaatagtcgttacattactggctttgatggtttacgcgcaatcggcgtgattggtgttattttataccatctgatgccatatacttttaccggtggttatttaggggtcccgatctttatggtggtttcggggtatctaatcaccgatttattggttcaagagtgggaacaaaatcaatggattaatttaaaaagtttttacttacgccgggtaaaacgattgtaccctgggctgataacgatgctgtttgcaacgggcgcgtacatcacgctttttcagcgggaaatgttacatcaacttaatcagattattatcacgaacattttatacgtttataactggtggcaagttggacatggtcagtcgtatttcgaccggtttgccaataatgagtcgccgtttacccatctgtggacactatcgattgaagggcagttctatctaatttggccttttatcgttgtggccttgattattggttttaagaataaaaatcggattgcccaagtattactagcagtcagtgttgtttcagcaatctggatggccattttgtaccagcccaatgctgaccctagtcgtttgtattatggaacggatacgcgggtcttttcaattttactaggagcagcgctggcgtttgtttggccatcaacagcccttaagcaaaagattgtacctaaacaacgcctcgtccttgacggcatcgggttagtgagtgtactcagtttggtttggttaatggttaagttgaatgccgagagtagtcttgtctatcgcgggggactatttctgtttagtgctttagtctgtgttttagtggcagttgtcgctcatccaggcgctgattggaatcggttattgacgaatccggtctttaactggttaggtaaacggagttacgggatttatctgtatcaatttccggtgatgattttctttgaaacaatcttcaaaaatatcgctgatcacccggttttatatccagtgattgaagtggcgattatcttcggattgaccgaattatcctaccggtttattgaacagccactagcacactatccgtacaagcagttatggcaccaattgaagcaatttatgcaccaaccacattggaatcgggtggttggtcgagtgactggactcgcaattgtctttttaatcgggttagtcggggcgtttcaagcgccattccaaccggcgccagatacgcataaatcggcattagcggtcaatattaagcaaaatcaaaaagctaaccaaaagcgtaaggatgcgttgattaaaaaagcaaaagcccagaataaagctgcacaagcaaatggtccaacttcaaaagctgaaaaagcggctgaggcggctgcgcaaaagcatccaatcaaccaagaatttgaaaaatatggcttgagtcaagtgacgattcaacgggcccagaatatctcggtgactgcaattggtgattccgtcctactcgacggtagtcaagctttacagaagttattcccgaatatgttggttgatgcggctgttgggcgccaactctatcaaagtattcaaattgtaaaagattatgatcaaaaacaagcccttagcgatactgtactggtcagtctaggaacaaatggcgcctttacgcaagaacagatggcgcaatttatggcagccattgggactaagcgaaaagtctattggctcaacgcgtttgtcccaacgcgtccttggcaaaatgatgttaaccagacgcttaaaaatgcaaccaaacagtatccaaacttaacggtgattgattggtattcacaggctgccaaacacagtgactggttctaccaagataaggtgcatccgaacccaactggggtcaatgaatatgctgccattattaccaaagccctcgcggcaaaataaagcgttgaattaaagacagattggaagagctaaatggaattagaatttttaggaacaggcgctggagtcccagcacgacaacgaaacgtcacaagtgtcgcattgaaattattggatgaacgaaatgaagtgtggttgtttgacgtcggtgaagcaacgcaacatcaaatcttaaaaacgacattaaaaccgcgcaaagttaaaaagattttcctcacacatttacatggggatcatttattcgggttaccaggctttttatcaagccgatctttccaaggtggcgacgaaccacttacgatttacggccctaagggaactgaagaatacgtgcgcacgagtttaaaaatctctgaaagtcatttaacgtatccattgaactttgtcgttcttcctgaagaaggcgttttgattgatgatgcgactttccgggttgaatgtgctaaattggatcatcggattgccagttatggttttcggattgttgaaaaggaccatccgggggaactgcaagttgagaaactgcatgcagatggtgttccggctggtcctgtatacgcaaagattaaaaagggcgaagtggttacactcgctgacggtcgccaaattgatggcaaagattacattggacatgctcaaaaaggacggattgtgaccattattggggatacccgccaatgtccaccaattgaacgcttagcggctaatgcagatgtattagtgcatgaagggacctttggtaagcaagaacaaaaaattgcgcgtcaatatttccattcaactaacattaatgcagcaaaggtcgcaaaagccgcgcatgtgaagcggttattattgacccatatttctgcccggtacctcgggcaagcggtgcgtgatttacaaaatgatgcccgcgatatttttaaaaacacgaaagtagttagtgacttagatatctatgacattccgtttcatggtcgaaaggagtaaacagatgactaaattagcagcattgagagatttaaaccgtaaaattgtggtgattaccggcggctcgtctggtttaggacgagcgattgcctatgaagccgctagtaaaggggcgattatcgtcgttttggcccgtcgagaagctgaattggcggcggttcgcgaagaagcacaccggctttcaggacagccggcgtatgcatatgtcctcgatgtcagtgatccagcagcgattgaaaccattgtggctcaggtgcaaactgaagtcgggattccagatgtgttagtcaatgctgctggttttggaagttttgaaaatgcattcgacacatccatgaccgttgtggagcagatgttccgggttaatgtgctaggtttaatgtacatgacgcgcgcttttgggcggatgatgattgaacaaggtagcggccacatcattaacattgcttcaatggcgggcaagatggcaacgcctaagtcggccatctattcggcaactaagttcgcggttgttggctattcaaacggtttacgcttagaattaaaaccatttggggttcaagtgactaccgttaatcctgggccgattgatacagctttcttcgatattgcggataagaccggtaattatttgaaatcggtcgattgggttgttttagatcctgatcaactagcttatcggattgtgaaaacaatcgggcatgcaaaacgtgaaattaatgcaccatggttgatggcgatcggtgcacaattctatcaactggcaccacatatcggagactatgttgccggtaacttattgaataagaagtaggggggcagttttatgaaaaaacaaggtcgattaattacagtattggtcctagcattaattgtcgtaatttttgctgttttaaacgttgaaccagtcgccattaactttggattcacccatgttaaatggccattaatcatcgttattttggtgtcattattgattggcgccatcattaccttcttggcagcgactggcagcacgttgagccaacggaaagcgcaaaaggaaatgaccaaagaagtcactgaattacgcgacaatcaagctgctcaaattaaagcagcggttgaagcagaaaaaataaagaatcaaaaagcatttgataaagcgttagcggataaggaagctgaagtccatgaattacacgcgaaaattaatcaaatcacacaaacaagtgatcatcataatgcatagaaaaaagaggttgagatagcctctttttttgttacttttcaggaagaactcgcctaccagctctccgtcttaagtctgatttataagcgaattacttgaaagtttgacctattttgactattatagaattagtcagaataatctgacacttaatttaaaaaataactgaaaaaggaatgacgtctatgaatccagaacaaatgacacaagctgtccaagatgcacttgcagaagcgcagaaaatcgcgatgacgcgtcatcaaactgaaattgatattccacacctctttaaatatttagtccaaccacaacaactaggacggcaaatttaccaagaagccggcgcaaatatcgatgctcttgaggcggagattgatcgtgaaattgacgcaattccaacgattgaaggtcaaacgaattacggtcaaaacatctcacaaaacttgtaccaagtattaactgctgctgaaaaatacaaaacagaattccaagatgaatttttatcaactgagatggtcatcttgggcttaatgggtttgaaataccaggcactcgttcaatatttacagaaacaaaatgtcactgaacaaaaattaaagaaagtcattactgatttacgaggaggcgagcgtgtgacatctaaaaaccaagaagataattaccaagcacttgaaaaatacggaacggatttaatcaaagcggtccgttctggcaaaatggatccagttattggccgggacgaagaaattcgagatgttattcgaattttgtcacggaaaaccaagaataaccccgttttaattggggaacctggtgtcgggaaaacggcgattgttgaaggattagcgcaacgaatcgtccgtaaagatgtgcccgataatttaaaagataagacaattatttcactggatatggggactttaatcgccggggccaaataccggggtgaatttgaagaacgacttaaagctgtgttaaaggaagttaagaagagtgaaggtcggattctggtcttcattgatgaaattcacacgattgttggtgctggtaagactgaaggcagcatggatgctgggaacctcttgaaaccaatgttagctcgtggtgaattacacatgattggtgcgacaacgttggatgaataccggcaaaatatcgaaaaagataaggcgcttgaacggcgtttccaaaaagtgctagttcaagaaccatccgttgaagataccatcagtattttacgtggtttgaaggaacggtttgaaattttccacggtgtccggattcacgataatgccttagtcgcagctgcgacgttgtcaaatcgctatattacggatcgattcttaccggataaggcaatcgacttagtggatgaagccagtgccaacattaacgtcgaaatgaattcacaaccaacggaattggatcaagcaacgcggcaattaatgcaacttgaaattgaagaagaagcgttaaagaaagaaaccgacgccgcttcgcaaaaacgattggctgagacgcaaaaacaattagctgatttacgcgaaacaacgaataatttaaagatgcggtgggaaactgaaaaagaagatttgaaccgtattaatgataaaaaagcggaaattgatgctgctaaacggcaattagaagaagcacaggggaattatgatttagaaacggctgctaagttgcaacacggcacaattccacaattagaagaagaccttgccaaccttgaaaaggctgaaaagccagaagactggatggttcaggaatcggttactgaaaatgaaattgcaacggtggttagttcccaaactgggattccagtcgccaaattagttgccggtgatcgacaaaaattactgcgtcttgccgatgttctgcatgaacgggtaattggtcaagatcaagctgtcaatgctgtgacagatgccgtattacgttcacgggctggcttacaaaatccagaccgcccgcttggctcattcctcttcttaggaccaacaggggttgggaagaccgaattagcaaaagctttagctgaggatttatttgattctgaacggcatatggtccgcattgatatgagtgaatatatggaaaaatattctgtatcacgattggtcggtgccgcaccaggctatgttggctatgaagaaggcggccaattaactgaagcagtccggcggaatccatacacaattgtgttattggatgaaattgaaaaagcccatccagatgtctttaacattttattacaagtgttggatgacggtcgtttgacagattcacaaggacggacggttgactttaagaatacaatcatcattatgacctctaacttgggttctgaaatcttactggacggtgtagatgaagaaggtcaagtttcacaaacggctaaggaaagtgttcaagccttaattcagacgaaattcaagccggaattcttgaatcgaattgatgatacaattatgtttacaccattgagtttgaacgatattcaagcaattgtggtcaaaatgcttcatgatttatcagaccgtttgtcagatcaggaattgacattgacgatttcagatgctgctaaacaatgggtggcagaagaaggttacgatcctgcatttggggcgcggccattacggcgttttattacgaaccatatcgaaaccccattggctaaagaaattattgccgggcatatgttaccaggaaccacggttgaaattaacttaaaagataaccagttagtttttgaaaatcgctaacgattgaaaaagcgctgtaaatttaatttgcggcgctttttttggacatcaatcagggattattactgtcagattgatgtttgtatggtacacttattaaggatgatgtacagaatgttagtgacgattaaggacgattccactttgaaagtggtgtcattaagagtcgttaatcaattgtttttctgtaattgacttgctcttagcggataaacatagtattatagaagtcgcggacaaaagtagcgggacacgtgatgatttaaaatcaatttgaatgggattgagataatccttgccaaattccccgagttcggtatatcattaatgaatctaagatataaaggagtctgaaaataatggcagttccagcaagaagaacatcaaagacgaagaaacgtatgcgtcgtggacatatcaaattgaacacaccaaacgtacaattcgatgcaactaatggcgaataccgtgtaagtcaccgtgtatcaccaaaaggtttctacaaaggcgaacaagttgttacaccaaaagctaacgactaatcgtcatcgagagtttctgaataaggaactctttttttatgcagtttcctagttttcaatactagatggtggtataatgagtattgaataaaaggagattgataattatgaaaaatgaacacttgaaacaaaagctcgatcgtttacaaattatacgcttaccacgttggacagacctgcccgatttggaactatatatggatcaagtggttagttacatcaatcaatacctaaacgcgttaaatttagatgaaatcaccgcttcaatgattaataattacgtcaaaaaagaaattgtggcagcaccgattaaaaaacggtatacaaaatcgcaaattgctcaagttttaattattgcactattgaaaacgagtttttcgattgaagaaatcaaacaattgatgacagcggaaacacctaaccgaaatgaaaagcaactttatgattactttatcttaacgtttttagcagcgattcatcagttagatgaggattacagcccctatgaccaaggcaaaaatccagcaggtacattggtcactgaaacccaacaaacattgctgaaattagcatgtcagagtgtggtatataagattgcaattgggattactttgaagaaagaaccagttgaagaaaaaacgccagtaaaaaataagtaattgactagaaaatgagaattgaattaagattcacaaataattcagttacaaaaataatgaattcgtttacctctttctattttcgccgtaaaataaaggtaactaattagtttattaacaaatgttagttaactaatttttattcagagggttaatcattgtggttaagtctaaaaaaaatgaaagaggtgttttaggtggcagaaaagaagaagacgaataagttaacgcttggtgcgcttattctaatggtctttacgtcagtctttggatttacgaatatcccacgtgcgttctacttgatgggatatgcatcaattttttggtatgttttagcagctgttaccttctttattccttatgcatttatgctcggagaaatgggagcggcctttggtgaagcaaagggggggatttactcttggatggagaaatccgttaacgctaaatttgcctttgtcggtacatttatgtggtttgcttcatacattatctggatggttaacgtcgggaacgggatttggattccattatcaaacgcctttttcggggttgataaaacacaagaatggtcaatctttggtttgacaaatggtgtgcaaacattaggaattttagctattatttggatcattgtcattacctttgtcacatcaaaaggccttgataaaatcaagagaatcaccagtattggtggttcagctattacgttaatcaacgtgattttattcttgggtggtttgttaatccttgttttaaataaaggggtaatggcacaacctgttacaacccatgcattcttccaatcaccaaatcaaagctatacatcgatgattcaagtcttcagtttcgttgtatttgcgatcttcgcttatggtggtcttgaagttgttggtggattagtggatgaaactgaaaacgctaaggttaactttccaaaagggttagctatttctgctgtcgtgattgttgtcggctatgctgttgggatctttatgatggggactttcactaactggaacttcgtctttaccaatggtggtggcttcgccaaagcaaccggttcaaacgcaaccgttactttggggaacgttgcttatattgccatgaacaacatgggttaccaattagggttagcaatgcacttaagtgaacatgctgctattcaagttgggatttggctcagtcgttacatggggctttcgatgttcttagcacttagtggtgctttctttacaattattttctcaccattaaaaacaattatcgaagggacgcctgctgccttttggcctaagtcatttactaagaaaaatagtaataatatgccggtcaatgcaatgaaagtgcaagctgcaatcgtgattgtgattattgccttcgttgcttttggtggtaagagtgctgctaagttcttcgatatcttaacagcgatgacaaatgtttcaatgacattgccatacatgtttgtggcatactcatactttggctttaaaaaggatgaaagtatcgaaaaaccatttacaatttataaagggaagaccttctataaattctgtgtctgcatggtcatgttcacagttggttttgcgaacgtctttacgattattcaaccagcaattgatggtaatttaagtcaaacaatctggtcagttgctggccctatcttcttcacaattgttgcattatatatgtttaaccgttatgaaaagaaaacaaatttaaaataagtttttaaaagagcggccgttaagtggtcgctctttttgattcttttaggtaaaaacaaaccacaccttttaggtgtgggagctagaattagctttagcgttaaaaatccctttcgctatactagagattggctaccaaccaaatctaaaagcgaaagggatttttatcatgtctaaagtaaaagacgatagtagtttagcacataccagatggaattgtaagtatcatatagtgttcactccgaagtaccggcgaaagataatatatggtgagttaagacaagatattggtagagttttacgacggttatgtgaattgaaagatgtagaaatattagaggcacatgcgatgccagatcatattcatatgttagttaaaataccaccaaaaatgagtgtttcaagctttatggggtatttaaaagggcgaagtgcagttattattcatgagcggcatgcaaatttgaaatataactatggtaatcgaaacttctgggccaaaggttattatgtcagcacggtgggattaaaccagaaaacaattgaaaaatatatacgtgaacaagaagcggaagatcgagtaagagatagtattagtaaaaaagaatacactgacccatttaagaagtaagttagtatcagttgaacgattgagcggttggtggtcttttgttgggccccttaaaggggctttttcgcgtgtggtgagcccttctagggctaataaaaagccacccgctatgcgggtggatatttactggtcttaaaaaatgtgacacttcgtcgttttcgcttgaattgtgattctaaaagggttaagctaagatttcaatgagttaaatttcaatgaaaaggtgacgaatatgaaaaaaacaattgttggtttagtgaccagcttagggctaatcggtctattggctggttgtgggacaaccaaattaacaacgactaaaacaaattatcgccaaaatggaatggtggcagtcgtaaaaggttcaacaaccaagaaagctgatttacaataccggattaatcataatcatttccaaaaagcaacggtcaaagacggaacttatgtgattcaagtaccaacaacgactaacaaacaaacagtaacggtacaggctaaagcaaatggtaaaaccgttcaaaagaaggtaacgattgcagcgggcacatcagttggccaatatgccaagattgccgcacaatacaaccaggctttaattgggatggcgttatctaaggcagatcaaactaaagcgcaggaattgcaaaaacaagcagctgctgccaaagcaggccaacttgcacctgctgatctaatgacgcttaagcagcggcaacaggaagtacaagcagcaatgcaacaggcacaacaggcacaaaaggatcaattgctaccaactacacctaaaaatggggtgactgaatgggtcgcaacaaagcatgtcaccattcgcggttctgttgataatcaagatgtaatggggatgacgcttattacacctgttaaagcgctcaaagataaagcggcattgaaagattttgggaccagttttgcattgattgcgcaagcaacgggcgctgattccaaaaaagtgatgtccgaatttagcgattatacgaagaaaaacaaaaaaggcagtcaaaccacgatgaagacgattgaatcaaatggtgtgaagttcaataccggtttttcaacaagtgatttgtatatttacattacaaaataaacgtaaaaagggccgcaacataaagttgcggccctttttttgtgctttatttagctggatcttttggtaagacaagaggtaagaagttgagcaaaagcccaaaaataactgagacgataacagttgtttgaatgttaaagccggttttcgttagtttagaaccgataaatccaatgacaaacccaaaaatcaatgtccaaagtagattcataacgtatttcatagttggccttctttctttgattcaattctatgatattgtaacacgttttccaaagagaatcatttgaaataatttgttatactaagagtaatcgaattaacgaagaaagaaggggcgttgcttgccattcgttcaactacaggttaagagtacctatacgctcttggaaagtaccactaaaattgatgcactgattgaaagtgctaaggcgcgcggctatcagagtattgcgctgacggataagaacgtgatttatgggctagtcgatttttataaggcggccaaggcagctgagttacatccaatcttgggtttaacgcttgaaattggcggattacttcaaaccgatgaacggtttccgctaattgtattggcgaaagatttagttggctatcagaatcttttgaagctctcttctaaagtgatgactcaaactgatctggtttcatttactgatattacgcagtggttcagccatttagtagtgatcacgccggctcaagatggtgaattagtccgcctacttttgcaagcggaggagcaaacaacggcatatttgacgcaactccaggcggcagttgatccggggagcttgtacttaggaatcagtaccaagcaagcagcagccccccaacgtagcaggttaattgcattgagccagacgaccggagttccgctggttgcgttaggtgatgtgcgttatctagaaccagatgatgctttttcagtgcaagtcttacaacatattaaagctggtacgcaagttaatctccatagtggtgatcagacaacgccaggcggctattatttacaagctgctgatcagattacggccgagtttgaagcattgcagttggtcgaggccgtgcacaatacggataagattgcccaactctgtcaagttgagttgacctttaaacgggcccaattaccacgctttgaaacaccgcatcaagagtcggcaacggcatatctagaacagttaagtcagcaaggcttacaagttcggtttgccgatcaagcgattccgcaagaatatcaagaacgcttgcagtatgaattgcgagtgatcagcgagatgggctttgccgattatttcttaatcgttgccgatgtcatgcggcatgcccatgaacaacatattatgacgggcccagggcgaggctctgcggcgggggcgttggtggcctatgctttaatgattactgatgtcgatccgattcaatatcaattattgtttgaacgttttttgaaccccaatcggacgaatatgccagatattgatttggatatcccagataatcgtcgggatgaagtgctggcctatgtctatcacaaatacggtcggaatcatatggcgcaaattattacatttggcacactggcagctaaaatggcgttacgtgatgtggggcgtgtgtttggcttaagtcagtttgaaatgaatgattgggctaaggcaattccggacgtgctgaaaatcacgttaaaagaagcttatcaacaatcacaaccattgaaaaatttggtggccgattccactcaaaatcgattactattcgagacagcacagaaacttgaaggactgccacgacactactcaacgcatgcggctgggattgtgttaagccaagcaccgttaactgatacggttgcattacaaagtggcggtgaagagattgaacttacacaattgccaatgggcaacgtggaagaactgggcctactgaagattgactttttagggttacgtaatttagggattcttgctaatattgtaaagcttgttggacagcaaacgggacagccgtttgacccacactcaattccgttggatgatcctaaaacacttgcattattccaacaaggtgatactaatggtattttccaatttgaatcacctggtattaagaatgttttacggcggttggcaccgagttcttttgaagacgtcgtggcgacagatgcgttgtatcgaccaggtccgatggaaaacatcgacgtatttatcgctcgtaagaacgggcaagaacctgtcacttatccggacgcgtcgttagccgatattttagcgccaacgtatgggatcttagtgtatcaagaacaagttatgcaggctgcgtccaagatggggggctttagcttaggcgaagccgacttattgcggcgagcaatgagtaaaaagaagaaggcggtgattgatgctagccggacgcaatttattcaaggcgcactcgaacgcgggcacacagaagctgctgctacaacagtctacgactatattgagcggtttgccaattatggatttaaccggtcacatgctgttgcttatagtaaaattgctttctggttggcttatttaaaagttcatcagccagcagccttttttgcagctttattaaatgccgttttgaacaatccgacaaaaacgaaaacttacttagcagaagctaagaaacgtcaaattaaagtgctgccacctgatattaaccgcagtcaaagttacttcagattagccgattcagggattatctttggtttgttcagcattaagaaagttcggcgcgattttgtggcggcgattatccaagaacggacaacgaacggaccgtttaaatcgttactggctttcttacagcggatggatcctaagtttctcaagcaagaggcattagaagccttgatttatagtggcgccttcgatcagtttaatccgaatcggaatgcgctgttgaccaacttagccgacctgcttgatagtgtgaagttgtcagggaataacgtcgatttatttgctgttttagcaccgaaagaacgtgccgtaccgaatttaaccttggccgaacgattggataaagaagctgaatatcttggggcctatgtttcggggcatccggtcgaaaaatatgatcgtgtgcgccaacactaccatgtgcctgatatcagtgatttggcgcccgagcaaacggtccatttggtgctattcattcgccgaattaaggtgattcgaacgaaaaaaggcgatcaaatggcgtttgtaacggggcaagatgcaaccggtgaaattagtgtgacgctctttactggcgtttatcaacgggtcagtgcatggctacaaacaggacaagttgtttttatcaccgggaaagttgaacaacgtcgcgatttacaagtggttgctaatcagattcaattggcacaagatgcacaaaagacgctacccaaagcgaccctttatttacgggttcaaacggcgttgacgagtcaagcgcaacaacaaatgtatcaattgttacaacaaaatcacggaacaacgccagttatcttgtataatgcggccgataaacagtcaattctattgaacgagcgctattgggttgtgagcaacgaaaaactaacgaccgcgcttacaaaccttttagggacgggaaatgtgattttaaaagggtttgaccaataaagaaattggtctatctttgcgaaaatcttcgcaaaagacaagacttattttctgaaaagtgataatatattagtgactttgaaagaccaattggttttttaagtaaaatatttgcctggggtgaaaagatgaaacgcataggtattttgacaagtggtggggatgcacctggtatgaacgctgccatccgtgccgttgcaagaaaagcaatgcatgaaggccttgaagtctatggtatcaattatggttacgctggtttagttgccggagatatcttcaagatggacccaattacggttggtgacaagattcaacgtggtgggacattcttgtactcagcacgttatccagaatttgcacaagtcgaaggacaattgaaaggtattgaacaactcaagaagtttggtatcgaagctttagttgtcatcggtggtgatggttcttatcacggtgcacttcgtttaactgaacatggttataacgcaattggtcttccaggaacaattgataacgatattccatttacagatcaaacaattggtttcgatacagctgtgaacacagtgctcgaatcaattgaccggatccgtgatacagctgctagtcacgaaagaactttcgttgtggaagtaatgggtcgtggcgctggtgatatcgcgctttgggctggtgttgccggtggcgcacaagacattattatccctgaacatgatttcgacgttaaggccgttgctgataagctacgtacttcacgtgaacatggtcaaaaacacgctgtcattgtattggctgaaggtgtgatgcacgctgatgaattctcagaaaaactttctgaatacggcgatttccacttacgttcaactgttttaggacacgttgttcgtggtggggcaccaacagctagtgaccgtgtgttagcaagtcgtttgggctcaaaagcagttgaattattgcttgaaggcaaaggtggcgttgcacttgggattgaaaagaacgaaattatcgcacatgatatgttagacttgttcaatcacaagcatcacgcaatgttagatctttatgatttaaacgaagatttagcttactagattcatcgttccatatataaaattgttaaaatgactgaaaagtcttttaaaaaatagacataaaaggagagattccacttatgaagaaaaccaaaatcgtaagtacacttggacccgcaagtaacaatgttgaaactatcgcaaaattaatcgaagcaggtgctaatgtattccgctttaacttctctcatggtgatcatgaagaacatttaagccggatgaacatggttcacgaagctgaaaaattaactggtaaaacagttggtatcatgttagatacaaagggtgctgaaatccggacaactgttcaacaaggtaagaaatttgaattacacactggtgaagtggtacgtatttcaatggacgatacacttgaaggaacacctgaaaaaatcgctgttacttacccaggtctatacgacgacacacatgtcggcggacacgttttaatcgatgatggtttagtggatcttaaaattattgaaaaagacgaagcaaacaaagaacttgttactgaagttcaaaacgacggtatggtcggctcacgtaaaggtgttaacgcacctggtgtttcaatcaacttacctggtatcacagaaaaagatgctagcgacattcgttttggtttagatcatgaaatcaactttatcgctgcaagttttgttcgtaaacctcaagatgttttagatatccgtgaattattagaagaaaaacacatggaacatgttcaaatcttccctaagattgaatcacaagaaggtatcgacaacattgacgatatcatgaaagtttcagatggtttaatgattgctcgtggtgacatgggtgttgaaattccatttgaaaatgttccttttgtacaaaagaacttgatcaagaaatgtaacgctattggcaaaccagttatcacagctacacaaatgttggactcaatgcaagaaaacccacgtcctacacgtgctgaagttaatgacgttgctaacgctgttattgatggtactgacgcaacaatgctttcaggtgaaagtgctaacggtgactacccagtagaagctgttgcaacaatggctcgcattgatgaaagaacagaaaaatcattaacagaccgcgatgcatacgcattgaaagcatacagcaagactaacttgacagaatcaattggccaagctgttgctcacactgcacgtaacttaggaatcaagacaatcgttgctgctacagaatcaggctcaacagcacgtatgatttctaaataccgtccacaagctgacatcttagccgttacattcgacgaacgtacacgtcgtggtttaacagttaactatggtgtatatccagttatcgctaagaaacctgctaatacagatgatatgttcaacttagctacacaaacagctcaagaacatggttttgctaaagaaggcgacctaatcttgatcactgctggtgttcctgttggcgaacgtggcacaacaaacgttatgaagatccaattaattggttcaaaattaacacaaggccaaggtgttggcgatgaaacaatcgttggcaaggctgttgtcgcttcaaacgctaaagaagctgctgaaaaagcaattgatggtggtatcttagttgttaaatcaactgacaaagattacttaccagcaatcgaaaaatcaagtgctatcgttgttgaaaacggtggtttaacatcacacgctgctgttgttggtatcgctatgggtattccagttgttgttggtgctaaagacgcaacagaagctatcaaagatggcgaagttgtgactgttgattcacgtcgtgggattgtttaccgcggtgcaacaaacgctctttaatcattcctgaatgatgaaatgaagccccctctgaaaagagggggctttttttgttttaaaaatgcgaatcttgaattacttttctgaaaatactgacaagtcgttcatttatcggtacaatagtagggagactttattggaggtttacatggaaagttggttatttttagtagcgattttaatcgttgcattgttagcgaaaaatcaatctttaatcattgcgaccgcggttgttttaatattaaaggtattcccgatttcaaataaggtgctgcctgtgatccaagccaaaggcattaattggggagtgacagtgatttcggttgctatcctagtcccgattgcaacggggcaaattggtgtcaaagacttaatcaatgcctttaaaacgccggcgggttttattgcagttggttgtggcgtgttagttgctgtactatcagcgaagggtgtggggctattgtccgctagtcctgagatgacagtggccttggtttttgggaccatcatgggtgtcgtttttctaaaagggattgcggctggccccgtaattgcagcggggattacttataccattttaacggtctttaatttagtaccaattcattaattaataagaataaaagaggttaactatgaatgaattaatcgggcaagttattactgccttagtaacagatgaaaatgaaacagccttctttgtccaaaaagacggcgtgacgtttgaattaaagaaagaaaatttagaacaagaattgaccatcggtgatacggtgactggttttgcttatgaaaactcaagtcgggaattgatcttatcaacgtttattcctaaatcacgcgtgggccattatgcccttggtgaagtggttgaaacgcggcgtgatttaggcgttttcgtcaatattggcttgccagataaggatattgtcgtatcactggatattttaccaaccattacgaaattatggcctaaaccaggtgatcgtttaatgattgcgattgaagtcgatcaaaaagggcggatgtggggccaactagctgacgaaagcatcttcagatcaatttcaaaaggtgctaaaccagaaatgaagaaccaagacgtgatggggacggtttaccgtttgaagttagccgggacgtttattttaacggatgacttttacattgggttcattcatccttctgaacgtgaagcagaaccacgtttgggtcaacaggttaaggggcgcgtcattggtgtgcgacctgaaggtagtttaaatgtcagtttgaaaccacgggcatatgaagaaattggcgacgatgctgaaatgattatggctgtcttaaaacggcaacctgattacgcaatgccatacactgaccggagcgatccagaagcgattaagagttactttgggattagtaaaggcagttttaagcgggcattaggccggttaatgaaaaatggcttaattactcaagcagagggcctaacgagtttaactgaaaaaggtcaagctgatattgccccaattacagatgacgagaagcaagactaagcttttttgaatgattgaaaaggaagttgctaaatggataaagctgagcaattagaccgaatatccgagcagctacaagcggccggctacaagttaacagcacaacgctctgcgacggtggcggtcattttggaccatgcccaagcgcatctgagtgccgaacagatttttatggcaactaaagaggtggtccctgaaattgggttggccactgtgtatcgtacccttgagatgttgacggaactgcatgtgttgaataaagttcggttcattgaagatgggatgacccactatgacttgtgtgagactgatcacgaccatcatttccaccatcacctgttgtgtctgcaatgtggggcaatcgaagaaattcatacggatttattgcctgccgtggaacaacaggtatatgatgattacacatttacggtgttagatcatcgtttaacatttcacgggatttgtgcacgttgccaacagattaaccaacaaaatgggttaccagccaatcaactggatcctagtcgccaaattgacgtgacgcagttgtaaaagaggaagcacatggatgatttaattcaagattatttacattatttaaaagttgaacgcggtctttcggagaatacgcgccagagttatcggcaggatttacaacagtttgcggcgtttttacaacgtcagcaggttgccaattttactgaagaccgctttttaattttgaactacttgcaagaacaaactgatgcgcataaggcacaaagtagtattacacggagcatttcaacgttacgtaaattctatcagtatttagcgcgtgaaaagcagattacacaaaatccgatgctccaaatcgattcgcccaaacaaggccgtcatctaccggctgttttatcgacggcggagattgagcgactattggcggcaccagatacgagcaccgcacttggattacgagatcgagcgattctagaggttttatatgcgacgggattacgggtgagtgagttgattcatttgaagatggctgatttgcatttatcactgggcttaattcagaccctcggcaaagggaataaggaacggattataccgattggtgatgtagcggttgattggattaatcaatacctcgatcgtagccggaatcaattaacgaaggggcgtgctaacccgtacctgtttgttaatttccatggtaacgggttgacgcgacaagggatttggaagaacctgaaggcacatgttaaaacggctgggattgaaaaagacgtgaccccacatacattgcggcattcgtttgccactgtgctacttgaaaatggcgcagatctgcgaattgtacaagaattattggggcattcagatatttcaacgactcaaatttacacgcatattagtaagaaacatttgacagaagtttaccaacggagtcatccacgcgattaaattagatttgtcgcgctttataaactatggtagagttaatgctattagaactttgtttgatcaatggaggtcaacatgttattcaagtataaaaatgattatgaaaagattgcgatgggctttttatccttcgtaccggatttaaaagaagtcagtcatgtacaagctgaattggcgctctatacgtcggatgagcaacgcaatttatatttatggcgcaatgaagccggcgattttgccggtgttgtggggattgaactgggtgcggactatattttagtgcgccatatttcactgaacccttcggaacgtagcgacgggaactatttcaccatgttggatgaattagcggcgctttatcctgaaagtcgcgtgatgggttcgttagagactgcgccattgattgctaaatgggaacaacatcagaatacagaaatggactagattgaccaatgactgaacaattaacgttggtcttgactgattttgaaggaccactcgatttattattacatttaattaagcaaactaagattgatatttatgatattcccattgctgaaatcaccgcgcaatatcttgattacttgcaccaaatgcaagtattgaaactagatgttgcaggtgattatttagtaatggcggcgacgttgatgaagattaagagtaagttgctcttacctaaggcgcctgaattaattgaagaagaaacagaagaatacgtcgatccacggcaggaattagtggaccaactattggcgtaccaagccttccaaaaggtcgcaacggttttgcaagagcgcgaattggagcgccaacagctctttgctaagccagctagtagtaatccggctgaaaaagtggtcccactagcgcgcggcgtgattaagccacgcgatttagctgccgcagtttctaaaatgttggtcgaagcccaagctaaacaaccggtcttcaaaacggtccaaaatgacgaaatttcgattacggataaaatgagttggattgtgcgtcatttagccgctcaaccagttgcttttgaagcgttggtcgttgttaaaacggatcgagatgaaatcgtcacaacatttttagccgtactagaattgatgaaggatcgaaaaattatttgcgaacaagccgactatgatgcaccaatcatggttcggttgaaggagggcatttcagttgaatcatctcgctgaaattgagagtttattatatgtcgcgggtgacgaaggaattgcgcttgcgcaaatcgcgcagcttattcatctcgatgaaccggcagtccgccagttattagaaaaattggcaaatcggtaccgcggcaacactgaatcggggttgaacctgattcaagccgaagatatctataaattagtcaccaaaaaagaatacgcgacgttgttgaagacctattttgatggaccggtatcaactagtattagtcaggccgctcttgaggtattggcaattattgtctatcgccaaccaatcacgcggattgaaatcgatgaggtccgaggtgttcaaagtagtggggccatccaaaccttgttagcccgccaattaattagcgaaaaagggcgtaaggatgcgcctggtcggccaattttatatggaacgagcacctatttcttagattactttggtcttgaatcgctcgatgaattaccaccacttgaacaattggcacttgacgctgatgtcgatggtagtgaaggtgatacagcagacttgtattaccgtcaatttgaacaaacgttaaatgaaacagatacgacgtcggaagagacgtccaaaggagaacaataaatggaacgattacaaaaagtgattgcaaatgctggggtagcttcaagacggaaagcagaaaccttaattgcaactggtcacgtcaccttaaatggtgaagtggtgaaggaaatgggtatcaaggtggatagcacaagcgatcatattgaagttgacggtgtgccgttaacgcgtgaacgcaaggtctattatgtcttgtataaaccacgccaagtgatttcagcagtgacagatgataagaaacgccgggtcgtcactgaataccttggcgatatcgttgaacgggtttatccaatcggccgattagattacgatacatctggcttattactactaacgaatgatggtgattttgccaacatgatgatgcatccaaaatataaagtcgacaagacttatattgcgaaggtttcaggattaccaactgcagatatgttgcgccaattgcgtaaaggaattgtcttagaaaaacgcaaaacagcaccagccaaggtcaaagtaatttcaactgatcggcgtaagaacactgccattgtaagcatcaccattcacgaagggatgaatcatcaggttaagaacatgctagctgcggttggcctacccgtaacgaagttgaaacgggaaacatatggtttcttaacgttagatgggttagtttctggcgaataccgtgctttgaaaccaatcgaagtcgcagaattcaaaaaaattgctgaactaaatgaaaaaccacagcataagaatcgaccaaaattatcacggcatgattaattagttgcttttggcacgttgatttgctatgcttatttcgaacaaaatattaatggttcgtcttcaggggcagggtgtaattcccgaccggcggtaaaagtccgcgacctgctacaatgttgattcttgtggtggctgaactggtgtgattccagtaccgatagtgaaagtctagatggaagaagatagggcttatttgggtatgaatgtatgcaagtaaggtctgttaatctccctgattaacagacctttttgatgcaatcagacttggctaagtccgctgacgaaggcaacctcatctggagggtgttagtaatgcaagtttcaaaagttcgtacgatgattggggtcgcaatgctaggggcaatttcatttgtcgtcatgtttttcgaatttccaattattctcgcatttccgtttttaaaaattgattttagtgacgtgattgtcctgttagggacgttcgtttacggaccaattggaggaatgggggtcgcattgattcgctcgacgcttcatttcattatgaccggtgctagcttaccgagtttggtcggcgactttgccggtgtcttggcgtcaatctgctacttgttaccattctattatttattcaagcgtcaatcgaacgttttagtaggtcaagcaattgctggtgttgcgggggctgtcagcatgacgatcttcatgtcatttgctaactggcttttcattttaccgctctatattaaattgatgggtttgaacttaggaatgtcgactaccaaatacattctatttggattagtaccgtttaatttaattaaaggggcactcgtaacggtggtgtttgccgttttatatttacggattttaccatggctaaaacaacatatgcaaaaaccaattgccaaataaatggcagcaaaaaaggttgtgtccaagcgggcacaaccttttttataggacgtaaatatgctacgataaaaatggcgttgattggcgtacaatcgcaccagttggacaggcggtgtaggcggttttaaacgcaattcgttctttaggatcttcaattggcgtcgttccctgattatgatcgggtttaaaaaaggcgatcccttcttgatcgtaatcgaataagtcgggcgcctttagctggcagagaccgcaggcgatacagcgttccgggatgacttgactatagagcattaaattcacactttctcaataaaggacttaattgatgatgttaatggcgtatctactatgcttgttggcgcctgagaaaaggcggtatcaagcaatctactataccttaattggtaaacgaactacttcaaatctgtatgccggtttagcatatggattattaaaatggctccagatttatcctaatctagaacaggcacaatttcaagcagaattaaaacgacttcagcaaaatggttggattgaaatcgatgagcggtatgtttggttgactgctaccgggcaacaaaaacaagctgaatggcagccgcaattagtttggccgacgcactatgaaggcccacagatgggtcacttaccccaattcactgctcgttttatgttggccgttcaaattgtgtcggaatatcatcatcaaaatacgcagtactatccattggaaacgagtatgaaggaccgcgtgttggtggtcagttggtttaagcggcataaggcaaccatcaattttagcagtcaattccagctagaattggcgcaattacttgaccagttagatccgcaacaagccgatcttgtggcaaatcaactgatcggacatcaagtcttgggcaaaagccaccaacaactggcgcaagccttagatagcacatccttgacagttcgtgtgcggaccatcgacgcctttgctcaaattttagggcttttattggcgcaccaaacgacttatccgctattgaatgaattagtggatcaggctgaaacgcaattgagtcagagtacgttacagacctggcaattgatccaacaaggggcgagtgttgaacaaatcagccgccagcgccgggttaagatcggaacgattaaagaacaccttttagaaaccgcgatgttactcccacggtttccgtttgaacaattcttaaaggatgcaactacacaaaaactagctagattgatgactgaacagccatcgctcagctataatgaagcacaaaccgcactccccggtctagatttctttgagtatcggctttatcaaattcaaaggcaggtgaacgcccaatgagcacggatgaactgatttataaaacgctaaaagagcggtttggctatgagacatttaagccaggacaattagaagtgattcaatctgtcttggcgggccaagcgactttggcggttttgccgaccgggacgggaaaatcattatgttatcaattaccagcctatcttttgggccataccactgtcattatttcacctttaattgcattgatgcaagatcaggtcgcacagttgaattaccaaggtgaaaaaaaggcagtcgcgattaattcaaatttggaaccgcggcaaaagcatgcgttattgcgacaattgccacagtatcgtttcgtgtttatggcgcctgaaacgataagccagccggcggtcattcaagcactacaacaatgccagattgatttattggtcatcgatgaagcccactgtatttcacaatgggggattgattttcggccggattatttagtgcttgcgcaaatcaagcaccaattaaatccgggggcaacgctcgcactaactgcaacagctgatgcacaggttcggcatgatattttagccaagctagatttgcagtcggccaataggattattacgtcggttgatcgtcctaatatttacttaggggtgagtcaacaagcggatgaagcgagtaagaacgcctttttgcaacaattggtaactgagagtcaggggcccgggattatttatttttcaagtcgtcaaaagactgtcgagattgcggcttttttgcaacaaaagacagcgatgcgagttgcctattatcacgcagcgctttcgccacgggagcgcttcattattcaacaacagtttatgcaagggcagttggacgtaatctgcgcaacgaatgcatttggaatggggattaataaagccaatattcgctatgtgattcactatcatttaccgcaaaatatcgaaagttatctacaagaagtcggtcgtgcagggcgcgatggccaaccagcctatgcaatgttgttagcaacaccgcaagatacgtatctgcaacagtcgttagtgtcatttgggattcctgaagctggattgattcggcgtttctatcaagaaccgacattatttaaacaaagccaaggcaacgagtttgaattattacggcggtatcagcaaattgggatggatgaacaggccgttagtgaactgttacagaatcggcaaaaagaaaagcgttttgcgcttcaaacaatggttgattatttaaacttacaaggctgtcggcggcaatttattgtgaactattttgacgagcaaccccaacaggttgcccatgctgatcaatgttgtggtcaacaggattcaacggtctttttagaaaaatttaatttaaaaacgttaactgatgataaatcccctaaaatagacgggttagaccattgggacggtattttgaagcaattgttttagagattttctgggtattttaaaagggtctatggtacaatatcaaagaataccaatagggagggccgtcaatgctcaaagatgataagaaaaaattagataatcagacggaagacaaaccctgggaaagccagtttgatgatgatcgtgatgatcgcgggaatttatcgcgtgttgcttccaagagtaaggaaaaaggaaatacatattttgccattattctaggtgtattgcttgttttaatgattgcatttccgattattgcctatacgattcattctagccgggctaaccgcccagtcgagtctagtaagattgtcgttaatacttctgatagtgatagtgcttctaagaaagaagctaaaaaagcgaagtctgctagcgaaagtgctaccaaagcggccagcgaaagtaaagctaaacaggctgaaagtgaaaaagcggctagtgaaagccaagcagttgaaagtagcaaacaagctgcagaagaagctgaaaaggctaatagtcaaagccaagctcaagcagacgctcaaaatagtagtagcgaagaaacaacaactgaaagtagcagttcaagcgaaacaacgggtggttcttatacgttgaaagccggcgaaggtttataccgcgcagcggttaataacggtttaacactcgatcaactacttgcattaaaccctgggttaacagtcaattcacaagtggcaccaggcacagctctaaaagttaaataatcagtactaccaaaaggcctggggaaactcccagccttttttaatgattttttcaggaggcagaacatgcaaattgcaattgatggaccagcatcatctggtaaaagtacggtcgccaaaattgtggctactaaattagggttcgtatacgttgatacgggtgctatgtatcgcgcatcaaccgtgttagcacagaaattagggttagacttcggggatgaagcgggaattttagcagctttaaaagaagcagatatccaatttaaacctgaccaagcagggcaaaaagtcttcttgaatggtgaagatattacattagccattcgaacccctgaaattacgaataatgtctcacaagtatcagctttagctggtgtgcgcactgagatggttgcacggcaacgtcagattgcagatcaaggtcaagtcgtcatggatggacgcgatattggaacaacggtgttacctgctgcgaaggttaaaatttttatggtggcaagtgcccaagaacgagctaaacgccgttatgctgaaaatacagctaaggggattatgacgcctttagcaacgctacaagcagagattgaattacgtgatcaaaaagatagtacacgggccatttcacccttaaaaaaagctgacgacgccattgaaatcgatacaactcagttaacaatcgatgaggtggtcgacacaatattagcaattgtaaagaaaaatatgtaattttatctttgaacgaggtaaaataactggtaatccgaatagatatcaactaaaatagtaactgtatagatagtcgttaaggaggattttagctatgagtgaagctaatttgaataacacccaaagcagcgatgcaatggcagctgctttagacagtgtccacgaagtcaaaattggggacgttgttaaaggtgaagttttagcaattgaagatcgacaagtgattgtcggcatcgaaggaactggtgttgaaggggttgtgcctcaaaaagaattatcaagtcaaccgattgaagacatcgcagacgttgccaaagtaggcgaccaattagatttagtggtcatttcaagaatcggtaacgataaagaaaacgggagctacttattatctaaacgtcgcttagaagcccgtaaagtttggtctgaaattgaacaaaaatttgctaatcaagaaacaatcacagctaaagtcatcgacgtggttaaaggcggcttagtcgtcgatgctggtgtccgtggcttcgtaccagcttcaatgatttctgatcgtttcgtacgtgatttaagcagctttaaaggccaagaattaaccttacaaattattgaaattgaaccaagtgaaaaccgtttaattctttcacgtaaagcattattggaacaagaacgtcaagctaagttacaagcagtttttgaaaaaatgttacctggggatgttgttgaaggtgaagttgctcgtttgacaaactttggcgcattcatcgatttaggtggcgttgacggcttagtccacgtttctgaaatttcatatgatcacattaaccaaccttctgatgtcttagaagttggtcaaaaagtgcaagtgaaagtcttgagcttagaccaagaaaaaggccggatctcattatcaattaaagatacgcaacctggtccttgggatgatatcgctgataaagcaccagttggtagcactttagaaggggtcgttaaacgtttaacaacatttggcgcctttgttgaagtcttccctggggttgaaggtttagtgcatatttcacaaatctcacatcaacatatcgccacaccaaacgatgtgttagaagaaggccaaacggttcaagtcaaggtcttatcagttgatcctgaacaacaacgtttaggtttatcaatcaaagcattgcaagaaaaacctgctggtgctaaggattcagaacacgaagatgtggcgccttctgactatgtgatgccagaagaagaaacaggtttcagtatcggcgacatgcttggtaaaacattagacgataaataatttttttaaaagtcatatgcaaaaaggtagggtctgggacaaaactaggttttgtcccagaccctacgtttatgtcggtgattgattagtacgacgcagaggaagcggaagttcagcggactttgtcggagtgaccttgtcagtttggctcagacagggtacactgaacaacgaagggaatgaatacaatgacaaaaccagttatcgccattgttggtcgacctaatgtcggtaaatcgacgatttttaatcgcattgccggtgagcggatctcgattgttgaagatacgccaggggttacgcgtgatcgcatttataccacaagtgaatggttagggcatgaatttagcctaatcgataccggtgggattgaaattagtgacgcaccatttatggaacagattaaacaacaagcagaaattgctattgatgaagcagacgtgattatcttcttagtgagtgcacgagaaggggttactgatgcggatgagcgagttgcacaaattttataccgcgctgacaaaccgatcttacttggggttaataaggcggataatccagaacaacgccaagatatttttgatttctatagtcttggctttggcgaacccatcgccgtttcaggggctcatggtcaagggttaggtgatcttttagatgccgccgttgctaagttcccagctgaagatgacgaagaagaagacgatagcatcaagtttagtttgattggccgtcccaatgttgggaagtcatcacttgtgaacgcgatgttaaaagaagaccgggtaattgtctctcaaattgaagggactacgcgggatgccatcgatacgaagttcacggctgaagataatcaagaatttaccatgattgatactgccgggatccgtaaacggggtaaggtctacgaaaatactgaaaaatacgccgtaatgcgtgcattacgtgcgattgaccgttcagacgtcgtattagtcgttttgaatgctgaagaaggtattcgtgaacaagataagaaagtggctggctacgcacatgaagctggtcgtgggattatcatcgtggttaataagtgggatacacttaaaaaagacaaccacacgatgaaagagttcgaaaatcacgtgcgcgatcaattccaatacttagactatgcgccaatcatctttgtatcggctaagaccggcgttcgcttgcaaaacttgccagcgatgattgaacaagtgagtgaaaaccaaaaccggcgcatccaatcagcactcttaaacgaagtcttgatggatgcaacaacggtgacaccaactccagctattaatgggaaacgattgcgcatttattacatgacacaagtagcggttcgaccgcctacatttgtggtcttcgtaaacgatgttaacttgcttcatttctcatatcaacgtttcttgaagaatcaattacggaaaacctttgactttactggtacaccaatccatttgatccctcgtcaacgaaaataagctgttttttcaaaaatccgctaatatgattaactaatttgctcagaatgctgttttttagcgaaattccttgctatcactaggtttgtgtgataaattaaaaaatgaaatggtgatcaaatcattgtttcgtcatttttgaccactcaaaaatggtttcggtaattaattactgattatctgtgatgagcaggaggtgaaaaacatggcaaacaaagcacaattgatcgaaggcgtagcatcaaagactggtttaactaagaaggatgcaactgctgcagttgatgcagtatttggttcaatccaagacactttgaaaaaaggtgacaaagttcaactaatcggctttggtacttttgaagtacgtgaacgtgcagctcgtaagggccgtaacccacaaactggtgcagaaattaagattcctgcaagcaaagtacctgcattcaagccaggtaaagcattaaaggattctgttaaataagaattcaatttataggctgggatttttcccagtctttttttattggcaattaatccgaatatgttaaaatggaacaatcgaaaaagggtggttaaatgacgaattcagaacaaatgcttacagcattagaagataataatttagaacaagcacagacttacttccaacaagccttagttgctgatgaacccgatacgctctacagcttagctgaagagttatatgcgatgggttttttggaacaagcaacgacaatttaccaacaattgttggcccaatttcctgaagaagatcaaatcagaacaacactggcagatattgcggtcagcaatggccaatacgacgacgccttgaacttgttggcagatattacgccagaatccaatgcgtacgccgaaagtctgctgacggcagctgatgtctatcaaacaatgggcttaccagaagttagtgaacaaaaattattgacggcgttgcgcttatatccagatgaacccgtcatgcaattcgcattagctgaattgtactttgaaatgggtgaatatgtgaaggccgccaattactatgagacgctcatcgaccaagacgttgttgaactgggacaggtgaatattcaaaagcggttggcaactagttatgccagcagtggggcttttgaagaagctttgcagatttacgaagggttgacgccagaatttctaacagaagacgatcaattccagatgggctttttgtacttacaaattaaggattatcaaaaagcaattgaaatcttaaccaagttacagacgactgatccacaatatacgtcactatatacttacttggcagcagctcaagaggctcagaatcaattagaagacgccttaacgaccgttcagaccggaattgggtacgatgcctacaacgaggtcctctatcaaaaggggagcgatctagcgcttcaattaggtaataacgaggttgctgaacagatgctaaacgaggctctcaagattgatcctgataatatgggcgaaattagtgccttgagccaagtttatcgccgtcaaggccgccatgccgaaaacattgctttcttacaagatgcgattgaaaatcataaaccaacggctgatttatattggtcattggcgcaatcacagatggcggtggatgatgttgaccaagcgcgcgaaaattatctgttagcttatcctgacttgaaagataactcggactttctacacgatttaattttattcttccaagaaatggcgcaggtcccagaaatgttagcggccctcaaacaatatttgaagctcgtgccaaacgatttagagatgcaaacgctctatgatgattaccaagccatgcagtagtactaaaaaagccctgactattaagttagtcggggcttttttacctttagttggtcagtgatggagaagaagcggtttgattcaaaatatcctgcgcccacgcgcaccattctaattctgttgcgcagaccattaagcgccgtttcaaaatcaggtaacgacctaagtttttctgcttttcggtgggatcggttatgaggttgtattcttgcatcttatgttggtattgtttttgaattttttggtaatgatggcggcgatcttggagtaagtcagctgcttgttcttgattgaacagtgaaataacgtaaacttttgctaaaaactcgtcacgttgtgtgggtaaattcgtttcttcttgaaaccagtcagtaacgacgagttggccggcttctgttaaatgataaatcttcttttgtttatgaacgggatcaattttaaccgtgacatagccttgttcgtgcagtttatttaatgccgtgtagatttgactgtggtgtgcttcccaaaataaattaatgtactgctttaattcgtagccgctacacggtttgcgaactaacatacataataaaatatagctaagcgtactcatattatttcaccctttaatcgattaattattgctcagtataccatatttagagtcaacaaacatgtcactatattatgtcaaattttaatgtaaaaattgatatgttttgcaatctaatgtagtttatataaagagaaagagagtgatatgttgctggagaatcaaaataaagggctacgcttggcgtatgccgttgcatttacgtgtatggttgcatttatggggattggtttagttgatcccattttaaaaacgattgcggttaaattaaatgccacaccagcgcaaacgaccttactatttacgagttatatgttggtcacagggattattatgctatttacagggtttatttccactagaattggtgcgaaaaaaacgattagtattggtttgatcattattgttttatttgcggcgttagctggtcgttcacagaccattacgcaattaatttcgctacgggccggttggggctttgggaacgccttgttcctatcaaccgctttgactgcgattgtcagtgtgatgcctgaaaaaacggaacaagcgattatgttatacgaaggatctttaggaattgggatggccgttggaccacttgtgggtggcgtcttagggagtctttcatggcgttttccgttttatggtgtcgccattttaatgttcatcgcagcattgaccatcatggtttcattagaaccgattgctaaacctgctaaaagggcgcctttttttgcaggggctgtcgcgttaaaaaatcatcgtttacgttcaatcgggattattgcattattgtataatttcgggtttttcacgattttagcgtatgcaccattcttattagttgggttaactgaattgcaagttggttttgtctttttcgggtggggcgtgatgttagccattgcatcggttttcattgcaccacggatggaacaaaaaacgaatacccttgtgacgttgttgtttgggttaagctttttcttgatctgcttaatggtgatcggtatttatgcagatcaaccagccttagtggcctttggcgtcatcattgctggtttcttccaaggcttggtgaatacgttgttaacgacggttgcgatggaaaatgattcgattgaacgcagtgttgcatcatcggcgtatagctttattcgctttactggcggggcaatcgcaccatttgttgctggtaaaatcgctgagaaatggtcagcgcattggactttttattttgcgagcttaatgattttaattgggattttctttgttctgcgcaatcaaaaatattttgtgacggttgaagaagttgaaaaagaaattgagttaactgagggacaggaattatcataaagacacttaaaaacgccagcgattaatcgctggcgtttttattgattagtcgtacgtaaagccttccccgagtgcttcgtgcacatcaataatggaaacgaatgcgtgcgggtcatgttggttaatcaaccgtttaagataggcgatttcacttggactgacgacacagtacagcattggtcggtcttgatgggcataagcgcctgtggcctgtagaaacgtcacgccgcgttccatatcggccagaatgtcatcggcaattgcttgcgcgtggtcactgattacgagtagccctttggcggcgtaagcaccctcgagtgtgaagttcacaatccgggagaagacgtaagacgcaattaaggtatacatcatatgttcgatatcgaggtaactgagtgagagtgttaagactacgacgtcaaaaagaaggagggagcggcccattggcatccctttttctttttcgataatgcgggcaatgacgtcggtgccaccagttgtgccaccgaagcggtagataatcccactgccgaagccaccacataaaccggctagaatagcggcgattaaaatatcgtggtttaaatcaattgtgatggggacacgttgccaaatccatagaaaaacggacatcatcgccgttccgtaaatcgtgtaggcgagtgcgcgtttaccgaggtaacgatagcctagaataattagcgggatatttaacaaagccgttgaatacgccgggtcgatatgcaaccaataccgtaaaatcaaggtaatcccggttaagccaccttcagccaggtgattttgaatgttgatggtcactagcccaaacgcgtagatcgcacagcccagcgcaatcaccgctaaatcacgactagtcgtttgccaagtatgttgtttcgtcatgtcaacgccccctttacataactcaaatatagcacggaatgggggttaaaaacagttggaaccactttggtggctgaagtggggtccttgattgtggtatgataaatagcatcagaaacagttaattgttagataagagggatagccatgaaagtaaccacctttgcgccggaatttgaagcggccctaccaatcttaaaacaaattgaagcggcgggttttgaagcctatttcgtcggcggcagtgtccgcgattatttattaggcttgccgattcacgacgttgatatcgcaacgtcggcgtatccagcagaagtgaagcaaatttttaaacgaacggtcgataccggaatccagcacgggactgtgatgattcttgatcatgggactggctatgaagtgaccacttttagaacggaaagtggctatcaagattttagacggcctgattcagtgacgtttgtgcggtcgttagacgaagatttacaacggcgggatttcacgattaatgcgcttgcgatgcgcgctgatggtgaaattattgatttattcgatggcctgaccgatctaaaagcgcaacaaatcagagcggtgggcaaagccgacgaacgtttccacgaagatgcactccgtatgatgcgtgccgtccgttttgaaagtcaactcggctttgcagttacaccagaaacacaaactgcgattgccaaacatgctgaactattaacgaaaattgcggtggaacgcattcatgtcgaatttgtgaagttgctacaagggattcagcggcaaaatgggttacaaacctttttaaaaaccgggttgtatcaatattgtccagcgttcgcgactgaagcagcgggactgaccaaattagcggcattaccagcgcaacagattcatgatgaagatacggcttggctactagtcaatgcattattgggtaaaacccccgccgccgccggcaaattattgaaacgctggaagagtgctaacgatgtgatcgatgcggttaaagcaggtttgggattattgccagccattctagaccaatcagccgatcagtgggccctttatcaagcggggcaacatgtattagacatcacgttaattgttgcccaattaatgaccaacgaatcagtcgcagttgatcagtggcaagcaaagtatgcggcactgcaaatcaagcaaaaggcggaactcgccatcaatggacaagtcttaatgcaaaatgggtatcaacctggtccgcaactaggaaaaatgttggcgcaactcgaaaaagccgtggtgttagatcaattaccaaacgatcaagcccaattattgcaatcggctgcacaaaactaagccattccctcagaaggtgtgttaaaataaccatgtaagcacattcagaaagggtgacaattgatgacacaacatgtttttaaggaattgaaattttattttagaaatggtgacgcttggaccgtcagccacaaagaattaaatgatatttggattagccgtgttaccaccagttatggtcgcattaatggtggcccaatgcaagagattcacccttgcaagagtttcaaagccgaaatcttacctgaagcggatcatgtgaagtccgaagacatcaacaccggttctcttgaaatggggatgttcggtcgtgcaacgaagtatcaagacatcgaaaaactcgatttaatctttgaagatgatcaagatcgcgcaccaatgcaaatttatttcccattcaagaataaagataatagtggcttagataatatttatcaaagtagccaaatctcacaaaaaaatggtcggttgtacattgtgattgatgcagaacacacaattgcagatatgtaccctgaaatttaaacgttagctcctgacaatattgatcgttgtcaggggcttttttatttgtttacagtttacgacattctttttgtcattttgattgtcagtcgtctgattattcgctatgattgatggtaacgaaagtaaaaaggtgactatattgcaaacattgacagcaacgcatttaacgaagacttacggcgaaaaaacgctttttgaagacatttcatttttaatccgtgaaggggaccgcattggtttagtcggcattaatgggaccgggaaaacgacgttactcaacgcgattaccggcacggattcatacgatagcgggcaggttgaaacgcctaaccaatacgcgatgagttatttagcccagaaaccaagctttgatacgaacttaagtattatggcggcgatttttgccggcgataatccggttttcaagacgattcaaaactatgaacgcgtcttggcggcatatacgcaagatcccactaatccgaagttacagacgcaatacgaacaagctgatgcgcaaatgacgcaacaagatgcttggacggttgatacggatatcaagacgattttgacgcaattacatctaacggatttggatcaaccgattaatacattatctgggggccaacaaaaacgggttgggttggcacaagccttaattgaaagcccagacttattgattttggacgaaccaacgaaccacttggattttgattccattgaatggcttgaaaaacgcttagcacaatatcaaggcgcgcttttaattgtcacgcatgatcgctacttcttggatcgtgttgcgaaccaaatttttgaactcgacggtggtcaactctattcatataacggtaactatgaacaatttttaacccaaaaagctgatcgcttggaacgtgaacaacaagctgcccataagcaacaacaactctacaagcaagaattaacgtggatgcgcgcgggtgctaaggcacgaacaaccaagcaacaagcgcggattaatcgcttcaatgacttaaaggcgaatttaaccactggaccagacgattcggaagtcgatattcagatggggcaatcgcggttaggtaaaaaagtactcgaattaaagaacgccagtttaaaactcggcgatcgtcagattttggatgactttagtattctagttcaagcgaatgatcggattgggattagtggcgtcaacggggccggtaaatcatcactgttaaacgtgttggctgaacgcctcccacttgatagtggcgagttaattgtcggcgaaaccgtcaacctcggctactatacgcaacaaaatgaagacttagatcctaacaaacgagtgattgcatacttgcaagaagccggcgaagaagtcattggtaaaaatggggaccggatcagtgtcacacaattgttagaacaattcctattcagccgtcaaatgcacggcacattgattggcaaactttctggtggtgaaaaacgccgcttgtacttgttgaaaattttgatgcaacaaccaaacgtcttattactggatgaaccaactaacgatttagatattggcacgttgacgattctggaaaattacttggaaaactttaacgggactgtgatcacagtttcgcatgaccgttacttcctcgatcaagttgccgacaaactcttgatttttgaaggggccggcaagattagcaccgaagttggcctgttcagcgattacttggcaaaacaaaaagcaacaccaactaagtcagcgcctaaagcagcgacagcatcggttgaagaagcaccagttgcaaagaccaagcagaaattaacatacgccgaacaaaaggaatacgaacacatcgaagccgacatggaacaattggacgaacagattgaaaccatcaaagcagaaatgaacgcaaacggcgcggactatggtaaattagcagagtggcagacccaaatggatcaacttaaccaacaactagacgaaaaaatgacccgctgggaatacttaagtgaatacgcaaactgagtgctttgaaaagcacgttaaaaaactgagtgcgtttgaaacggtttgacgctgagcattaacttaatttggcgaattagcgatgtaatcgctgatttgacaaatgtcgttaagcgcaagcgccagtttcaaaaagcacgttaaaagaagtgcgttcaagcttgttcaacttttaagcattagcttagtgtgacgaataagcgacaaagtcgattatttggcatacgtcgctaagtgcagaaagttagcttgaaaagcacgttaaagaaaggaatccacatcatgtctgagcaaacctacttagatttagcacgtaccattttagaaacgggtcattataaagaagatcgtaccaacactggcacctatagtctgtttggctatcaaatgcgctttgatttaaacgaagggtttcctttattaaccaccaaaaaagtgccattcgggttaattaaaagtgagttattgtggtttttaaaaggtgattccaatattcgttacttactacaacacaataatcatatttgggatgaatgggcgtttgaacgttacgttcaaagtgccgattacacaggcccggatatgacagattttggtcatcgtgcccaaactgatgcggccttcaatactgtttatcgcgaccaaatgcaacagtttaacgaacggattttagacgatgaagcctttgccaaacaatatggtgaactgggcgatatctatggtaaacaatggcgtgcttggcaaacccgttctggggacacaatcgatcagattaaaaacgtgattgaacaaattaaaaccaatcccgattcacggcgcttaattgtctcagcttggaatccagaagacgtgccaagtatggtgttgccgccttgtcatacgatgttccagttctacgttaatgacggacggttatcgtgccaattgtatcaacgcagcggggatgttttccttggcgtaccatttaacattgcgagctacgcattattgacacatttgattgcgcatgaaaccggccttgaagtcggtgaattcatccatacgttgggtgatgcccatatttacagtaatcatattgaacaggtgaagacacagcttgaacgcccaattcatgccgcaccaaaattgtggctcaatccagataaaacaagcatctttgattttgatgtcgccgatattaaacttgaaaactatgaagcagaacccgcaattaaagcacccgttgcggtttaatgaggaggagcgccaatgttagcattcttatgggctgaagatcaaaatgggttaatcggtcaaaatggtcacttaccatggtcattacccaacgatcttgccaattttaaacacgaaacggttcatgaagtggtggtaatgggccggaaaacgtatgatagtttacccgtccaacccttacctggacgccaaaacattgtgattacgcgacaaccggatttagctgtggctgatggggtgtttgtgatgcacaccaaagcggaactgcttaaatatgagcaagccaacccgatgaaaaagatttttatcattggtggtgccgatatttttgcaatgtacgccgatgatgtcgattatctgtacgtcacaaaaattgctgaatcgtttgaaggcaacgtttatatgccaaaattagcgatggatcagttcgaattgatcagtcaaacacctggtgtggtggacgaacgtaatcgctatgcgcatacgtttgaaatttatcaacgccgttagaaagattcaattaagggcggtcgcagcgatgtaaccgcctttttgcttgctacaaaagtgacaactggcttttttttaatcagtaacttttggtgaaaaaagcgtgattgtttgatatactgtcaatagacataatcatagaaatcacggggtcgtttattgcccagatttcaagatagaaagcgtggctgaagtaatagtggctaatattaaaattgtaacggattcatccatccaactcactcctgaagaaattaaagaacatcatattacggttattccgttgacgattatgattgacaatacggtgtatatcgatggtgaaaccattacccgcgatcaatttatgactgaaatggcaagtgcgagtgccttacctaagacgagtcaacccgcaatcgggaattttgtcgaaacgtatgaacagttagcggctgatggcagccagattttatcaattcacatgctacgagcaattagtggcactgttgatacagcccgccaagccggcgagatggcgaaagcagatgtaacagttgtcgatagcgactttaccgaccgtgcaatggcattccaagtgttaaaagcggcagaagtcattgaaaacggcggtagcatggatgatgctttagcagccattcaaaacgtacacgatcatacgaagttatacatgggtgtgactgatctaaccaacctcgttaaggggggccggttgagtcatgcggctggtgtgatttcaagtttattaaatatcaaggtgatccttgaagtggctgatagcgaattaaaagtgttacgcaaaggccgggggatgaagaccattacgaaattcatcgatgaaatggaagctgatatgcgcgacttaaagattcgggcaatcgggatttcacatgcggatgggctagaattgagcgaaaaaattaaagcacaattgcaagtagtattcccaaacatcgaaattcttgtccggacaactgatccagtgattgcaacgcatgcgggtgcaggcgcatttgccgttatgtactacacagaggattaacaagattacaattaatgcattaacacactaaggctggttgacatttaattgtcccagccttaactattatctagaaataaccgaggtgtcacgtttgaagaaagcacgacagattttaattgatttaggcttatttgctggtgcgattttagtggtctttattatctggcaactattaacgccacggcccaaccaagcgcctaagacggtaacatcaacgtcttcagcggataaagtgatcaaatcaaaaccaaaaaagacgttgcagttggttgcgattggcgattcattgacgcatggtgttggtgatgagaccaacaaagaaggctatgtgtcattagttgccaatcagattcagcaagcaaccaagcatcccgtcaagaccgccaatttcggtgtgacgggcgataccagtgtacagattactaaacgcgtgcagaaacaaaagccgctacagcagcaattggcaaaagctgatattgtgacgctaactgttgggggcaacgacctaatggcagttttacagaataatttttttgagctgaatcaacgtcggattacgactggtcagcaaaaatatcaagcgaatttaaccacgctgatgatgcaaattagaaaatataatcctgatgccccaattttcatcatgggggtctacaatccgttttatgtctatttccctgaaatcactgggatgtcaaaggcggttgctgagtggaatcagaccgccaaaacggttgctaatgatttcaaagatacgtattatgtcaatagtgatcggatgttgacacggggcgatgggcattttgtcaaacagactaaatcgctcgctaaaatggatagtgcacagttgcaaaaaacattagcggctaacgagcatttgaacccctatatcagtccagatgatcatttccatcccaatcataaaggttatcaatgggtcacaaaggccttttggcaagtgatgaaagcacacaagcaaacgtgggattagagaaaggataggttatgacaaccagacaagcacatcaagcagcacagaaaacaacaactaaacggaccatcaattattggaaatacagtttcatcgtcttattagcagtcgtgatcgggacagttggtcttgtcggctacaacgtgacagcccctaagactgaaatgattaaaactgagaaaatcatcaaagctgatagcacttttgaaattcagatgcataagagacaaatcaatagtttagtcacctattatttacaaaactacttggaagattcaaagattaaataccaactcaccctggatcagcaggcgattttatctggtcaattcaagttcttagggtttccggtcgaattcaacctcttttttgaaccgtacgttttagaaaatggcgacgtacaattacgcgccaaacaattagcagtcggacaattgaaggtgcccatgtcgtttgtctttaattacatcaagcgtcaatacaaattccccaaatgggttattttggatgcacacaagagccggattacattacgcctaaatgagttcaagctcgaaaacgggatgcaagtaactgctaaacatatcgatttgaagaatgataagattgatttaaacgtctatatcccgctaaaaaataagaaataaggtgttcagatgaagcagagtttttatcgttacctcatgacccaacgtgatccgaataattatgaaccagttccccaatttgccaacaatgccttttttgaccaatctttccctaaacaaagcggcgattatgaaacattaacgcgctatttggaacttaatggcagctacctcccgagtatgacgatttttgatgaggcgtatgaagcctatcaggaaagcgaacaagcctaatgacttccccgaagcagaaattgtggcggggatgggccattaccggctattggcttctcgcatttttactggctgggacggtagcgattgtgttacggtcgttcattctggtccccgcatcggtgtcagggcaatcgatggccccgacgcttgagtcagcggaccaactcttattacgcactagtgggcccatcaagcgctttgatgttgttgtcttcacccgagctgatcaaacaacttatgtgaaacgggtgattggtctgccaggtgaaaccgttgcataccgcaatgaccagctgtacatcaatggacggcatgtcgacgaaccattcttgaatcaggccaaaaagaaaccagggattttaacatcagattttgaattaaaaaccttaatcggcgaaaagcagattccaaaagatgagtactttgtattgggtgacaatcgccagattagcaaagatagccgtttgtttggtacgatccaccgcgatacaatattaggccgagcagtggcggtctactggccgattaaagatatacaatctttaaaataataattaaaagctgacatactctagagtgtgtcagcttttttgattatcgagtgctaatgatcgtatgaaatgtactgaatatgatgcttaactgaaaaaatgatacgcttaattggtggatgttgtagtccggaattaaatttaacccgtcagccagacatcaggtatgatagaattaagaataatacaatcagtgacaaatattaagaatgatgtatatcgcttaactagcaataaaggagttattatgacaattcaatggtatccaggccatatggcaaaggcccaaaaacaaattaaagaacggctcaaagcagtcgatttgattctcgaaatcgtggatgcacgggttccagaatcttccattaatccgatgattgcagaacttggtcaaaacaaaccgacgctcttgattatgaacaaagcggatatggcagatgccaaacgcacacaacaatggattgaaacatttaaaaaacgggggattacagcaatcgcgcttgatgcgcaacataaatcaaaattaccgcaaatcgaaaaagtagcacaagaaattttggcagacaaacttgctaaaaaacgggcaaaagggattcttaatccggtgatccgtgcaatgtgtgttggggttcctaacgttggtaaatcaacgattttgaatcgcttggtgcaaaaaaacattgcggtaacaggtaatcgacccggtgtaaccaagaatcaacaatggttaaaagcgggccaatcactcgaattgttagatacaccaggggttttatggcctaaattcgaagatccagctgtcggcaataagttggccttaactggtgcgatttcggatgcaatttatcacccggatgatgttgtggtgtatgccctcgattatttcaaggatttctatccgcaacaattggtaaaagaataccatgtgacgccggctgaacttgaaatgccagcgcctgatttaatcatggcattgaccaaacgactaggttttaaagaagactacgatcgcttctgtatgaaattcatcacggacgcgcgtaagggtaagttagggcgctttacactcgatatcgttcctgtggaggcgcactaatgaccaaaccagaatcaattgctgccattaaggcacgcttattagacgacatttcagaggaagaagtggcgctcttacgcagtgatgcgcgtgctggcgtgcagaagttactcgttcaatatgacaagcggatggctaagttagcggcgcaaaaagcggcgtttatcgaacgacgccagctagaagaaagtttatggccagattatcccttgattgctggaattgatgaagttgggcgcggcccattagcgggtccagttgtgacagcggccgtcattttgccacatgattttgacctatggcaagtcaacgactctaaacagctttcgtttaaggtgaaacaagaactgtatcgcggtatcatggcacaagccatcagtgtcagcattgggattgccgatgcaccacggatcgaccaagagaatatctatcacgctacggaactggcgatgggcgaagctgtcgctggtttagcagaacaccccgattacctattggtggacgcaatgaccgtgccgacagacatcccacaagaaaaattgattaagggggatgcgcgcagtattagtatcgcctcagccagtattgtggctaaagtgattcgggatcaattgatgattaattatgatcaacagtatccgggttacgatcttgctaataatatgggttacgggacagcgaaacatctcgctggtttagctgaattcggtgttacgccaattcaccgccgcagtttttcgcccgttaaagacgccctatagaaaataaaacagctcctttacgaagataaacgtaaaggagctgtttttttgtgttgactaaaaagcaattattattgaaagtacacctggcagatgggtttggccccatcagtgaattacgcttagccgcatggttagtaacgagtcacaattgggctttatcggcattggagattgcgcagattgcgtgtttaccggagcgatattggctgacctttcagactagttttgacagtctagctctgcaacagaagtgtgccacgcatgaacgttatgttcagtatctgacgattctagaagcagattatccgcaacggttgttagaaacccattgtccgccaacagttttattttatcgcggcgatttaagtgttttgaaacagccatgtgttgcggtggttggtgcgcggcaagccacggagtatactaagcaagccctgcagcatttattgggattaccacaaacaacgacgattatcagtggtttagctcaaggggcggatgcgatggcgcatgaagttgcactccaaaaagggttacgaccgattggcgtgattggaacgggcttgaattgttattacccaccacaaaacgaacacttgcaacaggcggtcgctgaaaaagggttattgatatcagaatacggtttggacgtaacggctaagaagcaccacttcccagcccgaaatcggattattgccggactttgtcatagtttagtggtcacagaagcccgccaaaaaagtggtagcttaatcaccgctaatttagcattacaagccaatcgtaacgtatatgccttaccgggccaggttaatcattcattatcggcaggctgtaatcaactgattttagccggtgcaacgccgcttttaaatcaacaattgttattggacgagttgcattattttgattgagggttaattgttgacaattctgcggcatgttgttaatattaaagtcacaagttacttataaagtaacaaatggaattcaaaggggatttttaatatgaaatatgcaattacagcagtgacaggtcgttttgggcaagtcgcaatgaagacgttggctgacttagtgccagcagaacaaatcattggattagcacggaatactgaaaaagccactaaaatggtcccagctggtgtgaccgttcgtcccggtgactataacgatgttgccacattaacggaatcactcaaaggcgttgaccggttattattcatctcctcacaacctggtggcgatgtgccccgtgcgcaacaacatttaaacgtgattgaagctgctaaaaaggctggcgttaagtggattgcttatacgagtttcccacacgctgatcaagcaacaggtgctttagcaagtgatcacattcaaactgaaaaagcattggcagcatcaggcattgatcatacattcttacgcaataactggtatcttgaaaacgaaatggatagcattaaaggcgcattagcaggtcaaccatttgtttatggcgctggtgaagggcatgttggttgggcactcgaacacgactatgctgaagctgcggctaaggtattagtcaacgatcaaccaaaagcgatttatgaatttgccggtgcgccagccacttatgcggatttagctcaagcgattagcgagttgactaatcaagaatttaaggtagtatcattagatgcggctgattatcgtcaaagcctcgaagacaacggcttacctgctgaagtcgctgaaattgtcactggtattcaaacaatgattcaagatggtgatttagatgaaaccacttctgatttacccgatgtcttaggccgaccattaccttcattaaaagaagcgttacagacgattattaaataagcctgaattgatttcaaaaaggcggttgaatcatgaaatattctcataaacttagtgatgccattcatattttggcctatgtcgatatttttcaagatggtgatttatcaagccaagcgattgctgggagcatcgagtctaatcctagtttagtgcggcggctaatgtcactactggtgaaggcggatttattagcgactaaaccggggacgattgcccctaaattagcgcgcccagcggaacagattacaatgttagctgtttttcaggcgcttgatacagatcaacggttattacacgttgatgaaaaaacaaatccagattgtttaattggtagcaacattcaagcaacccttgatgcggcttatgatcaggtgcaaaaagctgcggaagcggagatggcaaccatcacccttgatcaaattattgcggggattcttgaacgcgatgcacaaaaaaatagtttgtcagtctaagttttttatctggcgactatataatagaagaaatcggggttcgaccaagtggttgaaccccgatttttggtgtgatttgtacgtttgaaaacaatttctctttggcatactgccaaacctatgctatgctttaagctgttaatatcaagcatactatcagttgacaatcgtcaaggtagtgttttatgctaatgaacgatttgaacaaagcgttctgttgaaaggggtttgtccatggcaggcaaaaatttagtcattgtagaatcacctgcaaaggccaaaacaattgaaaagtaccttgggcgcaactataaggttgttgcaagcaagggtcacatccgcgatttaccaaagagtcaaatgggtgttgattttgaaaataattatgaacctaaatatatctcgattcgcggtaaaggcgaaacgattaaagaattaaaaaagcaagctaaaaaagttgatcatatctatctcgcagccgatccggatcgcgaaggcgaagcgattgcatggcatgtttcccatattttaaaactcgatccaactgaaaaaaaccgggttgtctttaacgaaattaccaaagacaccgttaaaagtgcttttaaaaatccacgtagtatcgatatgaaactcgttgatgcacaacaagcgcgacgcgtgcttgatcggattgtcgggtattcaatcagtccattactctggcaaaaggttaaaaaaggcttgagtgctggtcgggttcaatccgttgcgttaaaactcgtgattgatcgtgaaaacgagattaaagcctttgttccagaagaatactggtcattggatgcggaatttaaaaagagtcgcagtaagtttaacgccagtttctacggcgtgaagggtaagaaattaccccttggcgataatgatgcggttcaagcgattttgaaacaaatcgataagactaaggatttcacgattgaagatgttaagaaacgggaacgcaaacgttttgcagccgcaccatttacaacgagttccttgcaacaagaagccaaccgtaagttgaacttcagaacgcggaaaacaatgatgcaagcccaacaattgtatgaagggattaaccttggtggcaaagaaggcacggtcgggttaatcacttatatgcgtaccgattcaacccggatttctaccggtgctaaacatgaagcgtcacaattcatccatgacaattatggtgaagaatatgcggcattaaaggcgcataagacgaagaatcctgaaggtgcacaagatgcccatgaagcgattcgcccaacgtcagtgatgcggacacctaagagcttgaaagacgttttaactaacgatcaatataaaatctataacttaatctggtcacggtttgtcgccagtcagatgacaccagccatttttgatacggtcgcagttaagattgctcaaggtgatgtcttattcaaggcaaacggctcacaaatgaagttcccaggattcacgaaactctatgtgtcatcacgtgatactgaagactctgctaaggataatgtcttaccagaacttgcagttggggatgcggtgaaactcgttagaactgatccagtgcaacattttacgcagccaccagcacgttattctgaagccaatttagttaaggctttggaagaaaacggtgttggtcgaccatcaacgtattcaccaacgatcgaaacgattcaacggcgttattacgtgaagttaaacgcaaaacgctttgaaccaactgagttaggggaaatcgtcaatggtttaattgtcgaattcttcccggacatcgttaacatcgactttacggccgatttggaacatcgtttggatgaagtcgaaacgggtaaagaagactgggtcaaggtgattgacaacttcttcaaaccgtttgaaaaagaagtcgaaaaagcgagtgaacaaatcgaaaaagtacaaattaaagatgaaccagctggctttgactgcgacatctgtggtgccccaatggttgttaaaatgggtcgttatggtaaattcttcgcttgcagtcgcttcccagattgtcgcaataccaaggcaatcgtgaaggaaatcggcgtcacctgtcccaaatgtggtaaggggcaagtcatcgaacgtaaatcgaagaagaatcgcttattctacggttgtgatcgttacccagattgtgattttatcacatgggataaacccgtcggcagaaactgtccgaagtgtgaacactaccttgttgaaaagaaaattaaaggtggcaaacaagtaatttgtccaaacggtgactacgaagaaaccgtccaaaaataattagaaaaatggagactagcaaatgagcacagaaccttttgtaaacgtgattggtgccggattagccggttcagaagcagcatggcaaattgcccaacgcggtgtgaatgtgcacctctatgaaatgcgtcccgttaaaatgacaccggcgcaccatacagaacaattcgcagaattagtgtgtacgaattcgctccgtgcgaaccaaattaccaatgcggttggcttaattaaagaagaaatgcgtcacttggactcattaatcatcagtgcggctgatcaaaatgccgttcctgctggtggcgcattggccgttgaccgcacaccgttttcacaaacggtgacggatcgcttagccaatcatgaacgtgtcacagttcatcatgaagaattaaccgattttccagaaggtcctacgattgtggccactggtccattaacgtccgaaggcttagctgaaaaaatcagtgccttaaacggcagtgatggcttgtatttctacgatgctgcagcgcccattttggataagaacagtatcgatttcgataaagtttacctcaaatcacggtatgataagggcgaagctgcttacttaaactgtccaatgactgaagaagaattcgaaaacttctacaaagccttgattagcgctgaagttgcagaaatgcatgactttgaagaagaaaagttctttgatggctgtatgccaatcgaagtgatggccaaacgcgggattaagacgatgttattcgggcctttgaaacccgttggattggaagatccgaatactggcaaacaaccatacgccgttgtgcaattgcgccaagacaatgcggctgctagtttgtacaacattgttggtttccaaacacatttgaagtggggcgaacaaaaacgggttttccgcatgattcctggtttggaaaatgctgaatttgtgcggtatggtgtgatgcatcgcaatactttcatgaaatcaccagatgttttattaccaacctatcaatcaaaacaacgtgacgatctattcttcgctggtcaaatgactggggttgaaggctacgttgaaagtgccgcttctggactagtggctgggattaacgccgctaaactggcgttggaccaaacaccggctgttttcccaacggatacggcgatgggatcaatggcgcactatattacccatacgagtgccaaacatttccaaccgatgaatgcgaactttgggattttcgaacctttgaaacaacggattcgcgataaaaaggaacggaaccaagcacttgctgatcgcgcacttgaaagtatcgaccaatttaagacgacactttaattagaatcttttaaatcccgccaggcttgtggtaaagtaatactaatcaagcttggagggatttttttggcgttagaacaagaatggcttaatctttttttacagtacttagtggtcgatcggcattactcgccagaaacccaaaaagcttatcaagctgatattcagatgttcagtgcttttttaatcgctaacggcggcttagcgtcgtttaaacaggtcacgccactggacgtgcagacttacttgaatgaaatggatcaaaaagaatatagtcgtgaaactgtcgcgcggcgaatttcgagtttgcggtcgttttaccggtatttagtgaaaaatgagttcgtgcaaaccgatccttttgaagctgttcaattaaaaaagcaacagcataagctgccgcggtttttttacgaaaaggaaatggacgcgctatttgctgccattgatggggatcaaccactcgatcaacggaatcgcgccatcttagaattactgtatgcgacggggatgcgggtgagtgagtgcgcgcagttgacggtagcacaaattgatttcggcttacgcgtcattcttgttcatggaaagggcaataaagatcgctatgtaccattcgggcaccatgctgaacgtgccttgcaagcttatttaaaagttggtcgtgttcaattgatggccaaaaaacaattggaccacgatgtcgtttttgttaatcatctcggagcgccaattacaagtcggggaattgaatacattttagatcagattatcaagaaaacaagtttaacgagtgacattcatccgcatatgattcggcatacctttgcaactcacttattggatcacggtgctgatctgcgaacggtgcaggaattattaggccacagtagtttatcaaccacacagatttacacccatgtcaccacagcccatttacaaaaagattaccgccaattctttccccgcgcgtaaaactcggactaaagtttgatttttttcaacgaaaaatagactaatattagcacacagtcttaaagactgctaaaatagaagtgcgttcaaaccggttatgttctgagaattagcctaacaaggcgaatgattactggaagcaattgtttgacttgtgtagctaaacgcaagaacatggtttgaaaagcacgttaagaaaaaagtaagtgctttcaagcttgttcaacttttgagcactagcacagggaagcgaattagcgataaagtcgctgatttgattcacagcgctaagcgcagaaagttagtttgaaaagcacgttaagccccgcccaatccccaaacaacgttaggagtaattcatatgacaacaatttgtgcagttaaacataatggtaaaacagctatcgccggtgacggtcaagtcaccatgggcgaaaaatttgtgacgaaggattctgctaaaaaggtccgtcgaatttatggtaatcaagtcgcaatcggctttgctggtggtgttgcagatgcctttacgctacaagaatggtttgaacaaaaattagaaaagtattcaggcgacctgcaacatgctgctgttgctttagcgcaagactggcgtaaagatccaacgcttcaaaaattagaagcgatgttgattgcggtcaatgcgactgatattttattaatttcagggaatggtgaagtcatcacccctgatacgctatcggaatcaggtgatcaagtgattgccgtgggttcaggcggcaatttcgcccaagcagcagctaccgcattattacttgaaggaaaagatgacttatccgttgaaaaaatcgtcacaaccagtgttgatattgctggtggaatcgatgtttacaccaaccacaacgtgattgtcgaatcattttaggaggtcgcacaatggacttaatgaataaaacacccaaaacaatcgttgccgaacttgatcaatttgtcattggccaagatcaagctaaaaaagccgttgcggttgcactatacaaccgttatcgccggatgcaactcagtgcaaaaatgcaacaagaaatcacgcctaaaaatctattaatgatcgggccaactggggtcgggaaaacagaaattgcccgacggttagcgaaagttgtcgatgccccatttatcaaggttgaagccactaaatttaccgaagtggggtatgtgggacgtgacgttgaatcaatggtccgcgacttagctgatgtggctgtgcatatggaagaaacagaacaatttaaaaacgttcgtgctaaggctgctcgtcaagcagacaagcgcttggttaaactactagtaccgggcattaaaaaggaacaacgtaagaacaataacaacatgaatgatttaatgaacatgtttaacgcgcttcaaaaaggggaaacaccagctggtttcggacaaactgaaccagaagaagtgacggatgatatccgtaacgaacggttatctgttaaagaacagttagataaaggcttgttagatgaccgggaaatcgaaattcaagttgatgaaccgaaaaaagttgccccaatgaacgatatgatgggccagatgggaattgatttaaacgatactctgggttcaattatgccgaagaaaaaaattacgcggacggtaacggttaaagaagcgcgtgaagttttcattcaagaagaatccgctaaattagtcaaccatgccgatatttaccatgatgcgctccaacgtgctgaaaataccgggattatttttatcgatgaaattgataaaattacggctggtggcaaaaaacaatctggtgaagtctctcgtgaaggggttcaacgtgatattttaccaatcgttgaaggctcacaagtcaatacgaaatacggtgttttgaagaccgaccatatcttatttatcggttcaggggcgtttgctgaatcaaaacccagcgatttaatcgctgaattacaaggacggttcccaatccgggttgaacttgaagatttaactgaaaaagacttcatccgaattttaacggaaccaaacaacgcacttgtaaaacaatacatggcgttgattggcgccgatggggtgcacgtcaccttcacgatggaagcaattggccgcattgctgcgattgccttccaagttaaccatgataccgataatattggtgcgcgtcgtttggccaccatcttagagaagctattagaggatattctctttgaaggtcctgacatgcagatgggggatatcaccatcacagaacaatatgtcaacgataagatcggtaatattgcagccgataaagatttaacccgctttattctataatttttaaaaggtggtattttaagatgatccaaattgcaaacgaatttttaacggtgaccctcagtccaaaaggcgccgaattacaaagtattaagggcgccgtttcggggcttgaatatttatggcaagctgatcccgatgtttggggccggcacgcacccgttttattcccattcgtggggcgttcaaaagcagaccaatatacgtataatggccaaacctatccgatgggtcaacacggttttgcacgtgatcgcgaattcagtatcgaagaacaatcggaccacgccgtgactttcttgttgaaagcagacgctgacagccgggccgtgtatccatttgaatttgaattacgtgtgagctatcgtgttcatgatatgcatttgacggttggctatgacgtccgcaatgttgcgccaagcgggccaatgtacttctcaattgggggtcatccaggatttaaagtcccattaacggatgacacgcaatttgaagattatttcttagactaccgcccacaaaaatcacgggttaagatcccattgcaaggggccttcattaatttgaacgaccggacgttagcaccaaccgacgtcgcaacggatatcaatcaccaattatttaaaaatgacgccttaatctacgaattaaagggtcaagccaatgaattcagtattcgttctgaaaaaacggaccactcagtgaccatgaaattggctggcgccccattcatcggtgtttggtcaccttatccaacagaaggcaaccttgtgtgccttgaaccttggtgggggattgcggataccgttgacgcaagcggtgaactttcagaaaaatttggtgtcaacgaactggctgcaggtgaaacgcttaatgcaagttatgaaattactgttcgttaatgaatgattaaaaaaacgcacttaccaagatggtgagtgcgtttttttagtaaactggctgtaggcgggtaacgcattctaaacgcactctgctagtttttccagtagttccatgctaagatataagttataaaatcataggttaggtagggtaagtcatgactgaagaaaagaagtattacggcgcggatgccatcatcgatagtttagtaaatcatgatgttgagtacgtgttcgggattccgggtgcgaagattgatcgggtttttgaacgactagaacatcccgttaatccaaagacgcccaaattaattttgacgcgccatgaacaaaatgcagccttcatggcggctgggattggtcggattacgggcaaaccaggcgttgtaatggcgacttcaggccctggtgccagtaatttagcgacgggggtcgtgacagcaacggcagaaggtgatccagtcttagccattgccggtcaagtgaaacgcgctgatttgttgcgactaacgcatcaaagcatgcgtaatgccgctttattcgcaccaatcacaaaattcagtgcggaagtccaagaacctgagaatttatcagaagtgattgctaacgcctatcaagaagctgaatccgctaaacagggcgcaacgtttgtcagcatcccacaagatgtcacggactcagaagttcattctaaagtgattaaaccgctaatggcgcctaaattagggccagccagtcccgttgaaacgacgcttttggcacaacggattaaagaagcaaaattaccagtacttttagttggtatgcgcgcttcttcaccagaagtgacagcagcgattcgcaatttagtggctgaaacccacattccggtcgttgaaacgttccaagcagccggtgtcatttcgcgtgatttagagactgatttttatgggcgagttggtttattccggaatcaaccaggcgaccgcattctaaaacgcagtgatcttgttattgcagtcggctatgatccaatcgaatatgaaccgcgtaactggaacgctgaaagtgatgcgcacattatggtgattgatgatatgcgcactgaaatcgatcataatttccaacctgaaaaagaattggtcggcgatattgcgcagaccctagactttttattaccttatatgaaggggtatcaactagcgggcgatgtgcgtgattatttagttgaattgcacgcagaactcaatcaacgtgacacggcacctgaaatgacgaccgataatccacttagtcatccgttgaacattatttcagaactgcaagcacgggtcaccgacgaaatgaccgtcacggtcgatgttggtagtcattacatctggatggcgcggcattttagaagttacgaaccacggcacttgctctttagtaacgggatgcagaccttaggtgtggcattgccatgggcgatcagtgctgctctagtgcggccaaatacacaaattgtgtcggtttcgggagatggtggcttcttattctcaggtcaagacttagaaactgcggtgcgtctgaacttaaacatcgtgcatattatttggaatgacggttattatgacatggtaaaattccaagaagaaatgaaatatggcgaatcagcggccgttaagtttggtcccgttgattttgtccaatatgcagagagttttggtgcaaccgggttacgggtcgaaaaagccgcagatcttggtaaagtattggatcaagcctttgccattgatggtcccgtccttgtagatgtgcccgttgattacaaagataatcaattattaggccaagcattattacctgaccaactcgtttaatttgaggaggaaaatcaatgacaaatgatgtcaaacgcgtttatcaacacggaacgttagccctattaattccggggctctttacagggacaatgaccgttgctgaattattaacccatgggaattttggaatcgggacggcgcgcggtttagctggcgaactggtcttattagatggccatgcttatactgtgaatggggatggccaagtgactgaactcgcacctgatgcgacagttccatttgcgacagtgcattggcaagattcatcattacctacacaagcggttcatcaacgcacaaaggctgagttagaaacgcaaattctagcgcaagcaccgttaaaaaacttgttttttgcggttaaaatgactgggactttcaaagtcatgcatacgcgggccgtccaaacacaacaggaaccttatccgaatttgactgctgcaacccgagtgcaaccggagtttgaacaaacagacgtaacgggcacgttgattgggtattatgcaccagcgctttatcaaggcgcagctgttgcaggctatcacgtacacttcttaaacgatacgcacgactttggcggtcatattctagactataccgtggtcgatgctcaaatgacgctccaaccgtttgaaacgtttgaacagcacttcccaagtgataacgaagcttttttaaagagtgactttgacttacaacaagtcaatgccgatattgaagaagcagaacactaaacattcaaaaagcccacggatttttccgtgggcttttttgtattttaagcatggtggttaattggaccgtacttgtggccgacttcaatcgggttagcgatggcgcggtgaacaaattgtttagcggtcttaatggcagcctcaattgtctgtcccttagcgatttcagcacagatgcaagctgaaagtgaatcgcccgtcccattaatatgggtggtttcaacgtaaggttctgatagccaaaattcttgtccatcggcaaggcaaacgtagtctgtaacgattgattgtccggcctcgtgatggcctttaatcatgacgttttttgcgtccattgccaatagtgcttggccagcagcttggaaatcagcaggtgtcttcagttcaataccagttaatttttgcgcttcgtagaaattaggcgttaggacagttgcaaggggcattaattctgtctttagtgtgttaaaagcatcatctgccaacaacaatgcttcatgcttggtaataatgaccggatctaacactaggggaccaaagtcatgttttttcaactgattagcaacggttagaatggtctcacggtcggttaacattcctgttttgcaagcgcgaacctgaaagtcggctgcaattgcttcaaactcggcatcaataaagtcgggagacagtgcttggctagcacgaatcccatatgaatttccagcaacacaggctgtcaaaatgctcataccataaacattacgggcaaaaaaagtatttaaatctgcttgcgcaccggcactgccatcagaatcggaaccggcaattgtcatgacttgcggaaagctatttaacattatcaacatctcttttccagagcggacggaacgtccatcacttaatatatcctaatattagtataagcttttaggtgtccttttttcaatcagcagaagacactaattaagtgaatttcgtgtatactatgaattaaataattgtcaggagggacttatgattcaattaaaaatcgaacgattatcttatcaggttgatcaacaagtgattttaaccgacattaatttaaccgttgaaaaaggcagttacttaacgattacaggaccttctgggggtggtaagagtaccttgttacggttaattgcggacttactaacgccgacaagtggcaccattttattaaatgatcagccactgacccagtttagtcccaatcagtatcgacaaaaggtttcgtattgttttcaacaagcaacgttatttggtgaaacaatcggggataatttacgttttccatacgagattcgtaatttaccggtcgatatggcaacaattgaaaaagcgttggcagcggttgggttagccaacatgccactaacgaaaaaaattaccacgttatcgggcggtgaaaagcaacgaattgccttgattcgtaatgttttatttccaccggaagttttattacttgatgaaattacgactggtttagatgccgctaataaggcaattgtattggcgtttgtccagcacctcaatgaggattgcgggctcacaattattgccattacccacgatacagaagaattacaacggaaagggcgccaggtgcaaattgttgctggcgaattggtaaatcaagatgaacttagccgttaatggtctttcactgacgtttgctgtgacattagtgtttgtcgcattagtcattagcttccatgaaaaaatcggtcttgaaaaagatatgattatcagtgtttttcgcgcaatcattcaattatttatcgttggttatttactgaaattcatttttcatattaacgatgtgtggctaacgttattgatgatgctgatcattatttttaacgccgcagcaaatgccaaaaagcgggcggggaaactacgcaacgggtttccaatttcatttatcgcaattttaacaagtactggggtcacgttaggattacttgttttatctggggcgattaagtttattccatcgcaaattattccaattactgggatgattgcttccaactcgatggtcgccattggcttgagttaccgcagcttactggcgcaatttaaggatgaacggcaacctgttttggaacgactcgccttgggagcgaccgctaaacaagcatcaattgccattattcgtgagagtattcgtacggggatgtcacccacgatcgattccgctaaaacgatggggcttgtcagcctgccagggatgatgtcgggcctgatttttgccggaattgatccagtcaaggccattatgtaccagatattagtgacctttatgttattatcggcaacgagtcttggttcagtgattgcgtgttacttagcttatcgatcattttacaatgaacgggaacaattgattgatctttaactgattgcacaaaaaaacgcccgttcggcgtttttttagttattgatgtttttgtttatagcgatagtacaggccaaatggcactaagttttcagtgccatttttaatgcgttgtagattttcgcggtgccggtagaccaggaaaagtaagaccaaggtcgcaatcgaaccgagtagccaatcatgcgtgtaaaacgataaaatcgcaatcatcaatggaccgaggatgctagccatgctaaccatacttgtaatcaggatgacactgataaagatggtactggcaattacgaagaaaagtggattgtatgccagtaagatgcctgcgctggttgcaacggcttttccccccgtaaagtgtaaaaagatggagtaagcatgaccgacaacggccgctaagccgacgattaagaccaatgcatgattggggatgtgaaaaatcatcggtaggctagcagcaagtgtgccttttaaaatatcaagaaataaaacggctgtcccagcgattgggccgagcacgcgatacgagttagttgtgccgatattatggcttccagcatctcggggatctttgtgacagaaaacgcggccgataataacgcctgatgggaacgaaccgatcaggtacgcaagaataaagataagactaagtttcatgacaaaaactcctatttgtggcatttgtttcccctattttagcattttgacaagggaaaaggaatattgtatgttagaataggtgaatacgaacatacatttgtattggcaagaaattttaaatttttgattgtaaaatcatccaaacttgttgataatataccttatctgttcatttttaaacaaaggagtcatacttgaatgccaaatcaaaaacaagattataatgataattcgattcaggtcttagaaggtctagaagcagttcgaaaacggcctggcatgtacattggctcaactgacggtcgcggcttgcaccatttggtgtacgaaattgtcgataacgctgtcgatgaagccttggctggttttggttcagaaatcaacgtcgtaattggcgcggataatagtattagtgtccgtgatcatggtcgtgggatgccgactgggatgcaccaatctgggattcctacgattgaagttattttgacagtgcttcacgcaggtgggaaatttacccaaaacagttataaaacatccggcggtttgcatggggttggcgcgagtgtcgtcaatgccttatccgaatggttgaccgtccgcgttgtgcgtgatggtgttgcctacgaagaacgctttgaaaatgggggccacccggttggtaccttgaaaaaagttggcaaagctaaagaaccaaacggcacgttaattacgtttaagccagatgggacaatttttcaaacgactacttataactacaataccttagcagaacgattacgcgaatctgcctttttactcaaagatgtcaagattacgttgaccgatttacgcgctgagccagcacgtgaagatgtcttccattacccagaagggattcaatcatttgtcgattatttgaacgaagataaagatacgattggtaataagttatatttcgaaggcaccaaagaagacattgaagtcgaatttgcgggtcaatataacgatggctactccgaaaacatcatgtcatttgtgaataatgtccggacaggtgatggtgggacccatgaagctgggatgaaagccggcttaaccaaagcttttaacgattacgcccgcaaggtaaacttgctcaaagaacgggataaaaacatggaaggctccgacgtacgtgaaggtcttagtgccgtcttgtctgtccggattccagaagaactcttgcaatttgaagggcaaaccaagggtaagctaggctcgccacaagcgcggacagctgtcgatagtttggtttatgaacaaatgagctttttcttacttgaaaatggtgaatttgcgcaagccttagtgcgtaaatcattaaaagcacgcgaagcacgtgaagctgcgcgtaaagcacgtgaacaaagtcgaaatggtaagaaaaagaagaaatccgatggcttattatctgggaagctaacaccagcgcaatcgaaaaatgcggcgaagaatgaattgtacttggtcgaaggggattctgctgggggttctgctaagcaagggcgcgatcggaaattccaagcgattttgccattgcggggcaaagttttaaatacccaaaaagcgaaattacaagaaattctaaaaaatgaagaaatcaacacgatgatttacacgattggggccggagtcggggctgaattcaaacttgaagacagcaattacgataaagtcatcatcatgaccgatgcggataccgatggggcccatattcaaattttgttgttaaccttcttctaccgctatatgcggccgttaattgaagccggaaaagtctacattgccttgccaccattgtataagctccaaaaaggtgctggggcaaaaacgaagattgcctatgcttggactgatgatgaattgaaagtcgtcgctaaagaaatgggtaaaggctacagtcaacaacgtttcaaagggttgggtgaaatgaatgctgatcaactttgggataccacaatggatccaacgagtcggacgttaattcgggtgcggattgatgatgcagccttagctgaacgccgcgtcacaacgttgatgggcgataaagttgaaccacgtcggaagtggattgaagaaaacgttaagttcacaatggctgaagatggtagcatcttagatacaacgaatggtcaaccagcaccgacaacttcaagcgctgaagtggatttatttgaccaattagacgaatagaaaagtgagtgattaaatttggctgatgaagcacaaaaaattcaagagctaacgcttgaagaagtcatgggcgaccgctttggccgctattcaaaatacatcattcaagagcgggcgttaccagatattcgcgatgggttaaaacccgttcaacggcgaattttatacgcaatgtccatcgatgggaatacttatgataaagggttccggaagtcagcgaagtctgtcgggaatgtcatggggaatttccatccgcatggggatagttcaatttatgaagcgatggtccggttaagtcaggactggaaattacgtgaaccactgattgaaatgcatgggaataatgggtcaatggatggggatccaccagcagcaatgcggtatactgaggcacgcttaagtaagattgctggtgaaatgctcaaggacatcgataaaaagacggttgatttcgttttaaacttcgatgataccgctgaagaacccactgttttaccagctcggttcccaaacctcttagtgaatggggcaactgggatttcagctgggtacgcgactgaaattccgccacataatttaggtgaagtgactgatggcttggtctatctattggatcatcccgatgcaacgttagaaaaaatgatgaccttcatcaaaggacctgatttcccaactggtgggatcttacaaggggtcgatgggattaagaaagcctatgaaactggtcgcggtcgagttgtcgtccgggcaaaaaccagcatccaacaattacgcggcaatcgggaacaaatcgtgattagcgaaattccttatgaagtcaacaaggctatgatggtcaagaagattgatgaattacgcgttttaaagaaggtcgatgggattgctgaagtacgagatgaaagtgatcggatgggcttatcagtcgttgttgaattgaaaaagcaagcggatagtcaagggatcttgaattatctgttcaaaaatacggatctgcaaatcacatataactttaatatggtcgccatctcgcatatgcaacctaaacaggttggcttattagaaatcctccatgcctacttggaacatcaagaagaagtcgtgattcggcggacaaaatataccttacaaaaggcattggaccgtcagcacattgtcgcagggctaatcaaggcgctctcgattttagatcaagtgattgcgacgattcgtggtagcaagaataaaaaagacgctaaagataatttagtggcaagctacgccttcacagaagcccaagctgaagcgattgtttcactgcaattataccggttaacgaataccgatgtgactgctttggaacaagaatcagctgaacttgatgcagcgattaaggaataccggatgattcttggtgatccaaaagcacttgcacgggtgattaaggcgcagttaaaagcaatggtcaaaacttatcggagtgaccgaaaaactgaaattgaagcacaaattgagacgcttgaaattgatacaagtgtgactgttgttgacgaaaccgtcatggttgcagttagccatgacggctacttgaaacgtagtagtttgcgctcgtatcaagcatctgaaggggccgacagcggtttgaaagacggcgattttgccattttacaaaagccactacaaaccttagatcaattgatgatgttcaccaattacggacatttaattcaacgaccagttcatgaaattgctgatttgaaatggaaggaaatgggcgaacatatttcgcaatcgattggtttggcggctgatgaagcgattattgcagcatttgcctttaagccaaatgaacaggctggctactttgtgattgggacggatgatggctatattaaacaaactgccttctctgacctcttgccaagtcgaacatatcgttctaaggcacaagactttattaagttgcatgcagatgctcatgtgacaaacgtgaactggattccaagtgatgaagggctagccgtctttagtgctagctataaaggttatggattgagttttaccttatctgaagtctctgtatcaggtgctaaggccagtggggtcaaattaatggatctcaaagatggggatgttgtcatcggctttacgttatatcatccagaagataaacatgcagccgttgccattgtgacgcaacggggcgcctttaaacggatgctcttaagtgaggttggtttaacaagtcgtgcgcgtcgtggggtcttaattctccgtgaattgaagaaagaaccacatcgggtagcagcaatggttagtgttgagcaggcaagcgagttactgattcatactgatcagcaagaagtgattgcaattaacccttatcaacatgcaactgccgaccgttattcgaacggtagttttgtgatggatgttgatgaagttggacaaccggcatttgttcaaacgactattccagttaaaaatgaagacgagtcaaaataataaaaaagcaagtcatctatgtgatgacttgcttttttctgttatacataatatgcggattttttggttttgtactataacagcaaaataagttttgcacaatttaaatggtggggttataaaaatattttaagtagataaatagctataaatcaatctttcaaaagagtttaagagtttctaaacaatcaaaaagaaagggcttgcataaactatgtgatgtgttatactaaaattgtgaaaactgtgataaacaacacttgactaatggaggtaatccacatggtaaaaaccgaaaaaattaacttagccgactattgggacggctttaacaaaggtgactggcaagatgaaattgatattcgtgatttcatccaacaaaactttactgcctatgacggtgatgaaagtttcttagctggtccaaccgaagcaacaacaacgttaaatgatcaactaatggaattgaagaaacaagaacgtgaagcaggtggcgttttagccgcagacaatgataatcctgcaacagttacgtcacacggccctggttatttaaacaaggatcttgaaaagattgttggattacaaactgatgccccattaaaacgcgcattcatgccatttggtgggattcggatggccgaagatgccttggaagcatacggctttaagactgatccagaacaacacaagatttttaacgaataccgcaagacacataatcaaggtgtttttgatgcttatacaccagacatgcgtaaagcacgtcactacaagattattacgggccttccagatgcctatgcacgtggtcggattattcctgacttaccacggattgcagtctatgggattgatcgtttagctgaagaaaaagtccgtgactttaatggtgttggcgacggtgaaatgacagacgatgtcattcgtcttcgtgaagaaatcaatgaacaatatcgtgctttacaagatatgaagaaaatggctgctagctatggctttgatatttcaagacctgctaagaatgcccaagaagcaattcaatggatttacttcggttacttagccgctattaagacacaaaacggggctgcgatgtcagttggccggattgatacaacgatggatatctttatccaacgtgatttagagcggggcttaattacagaagctgaagcgcaagaaatggttgaccattttgtcatgaagttacggatggttcgtttcattcggacagaagattataattcattattctcaggtgatccaatctgggcaacattatcaatgtgtgggattggtatggatggtcgtcatcatgtcactaagactgccttccgtatcttgaagacattggaaaatatgggtgctgctccagaacctaatatcaccttactttggtcagatcgcttaccagaaggtttcaagcgctatgcaacagaagtttcaattaagagttcaacgattcaatacgaaaacgatgatttgatgcgtaatgaatgggggagtgactattatgggattgcatgctgtgtttctgcacaaccgattgcagacggcgttcaatattttggcgcgcgtgctaacttggctaagacaatcctttacgcaattaacggcgggatcgatgaattaggcaaagctcaagtcggcccagcttatcaaccaattacaagtgaaatcattgattacaaagaattcatgggtaaatacgataagatgttagattggttagcagacgtttacgttaatgctttaaacaccatccactacatgcatgataagtattactatgaatcagcacaattggcattgaagaatagtcgtttagaccggacatttgcgactggtatttctggtctatcacatgcggttgattcaatctcagcgattaaatacggccaagttaaagttatccgtgatgaagacggtatggcagtcgatttcgaagcgcaaaatccagactatccacgttatgggaacaatgacgaccgcgctgacgatatcgctaaatggttagtgaagactttctatacgaagatgaatacgcatcatttatatcgtggctcaaaattatcaacatctgttttaacaatcacatcaaatgttgtgtatggtaagaatactgggacaacaccaaatggtcgtcaagctggcgaaccattctcaccaggtgctaacccagcatacggtgctgaaaagaacggtgctttagcatcattactttcaactgcgaagattccataccgttatgcaactgatgggatttcaaatacgtttggtgtcacaccaaatacattagggcatgatgatgaagcacgtaaagacgcgcttgtgaacatggtcgatggttacatgattaatcaagggatgcatttaaatatcaacgtctttaataagcaaaccttaatggatgcacaacaacatccagaagaatacccaacattaacggttcgggtttcaggttattgtgtctacttcgctgatttaacgaaggaacaacaagacgacgttatctcaagaacgttctttgacgaaatgtaatctaacgaaagtggatagcaatatccgctttctggtaaggtcgttaacgcgaattaacgactttaccagaaagcatagcttttcttttaagaggtgaaagtgaaatggcaattaaatttacaacacggttatcaactgaaaatgttgttccagaaaccccgataacaccagaggtgccaattggatatgttcattcgattgaaacatttggttcagtggatggtcccggaattcggtttgtcgcctttctacaaggctgtcgcatgcgttgcgaattctgtcataatccagatacgtggaatattggtagcggagaagcttataccgcagacgaattaatcgcaaaggcactgccatataaggccttctggggtaaagatggcggaattacctgtagcggtggtgaatccttaattcaaattgattttttaattgatttatttaaaaagtgtaaggtacaagggattaatacctgtttggatacttgtgggcagccgtttacgtataaagaacccttctttagtaaattcaaagaattgatgaaatataccgatctttcaatggtcgatattaagcatattgatccagcggggcacaaaaagttaaccggcttttctaacgaacatattttagaaatgattgaatatatgtcaaatcatggtcatcatatgtggattcggcacgtcttgattccagaacggacggattacgatgagtatctcactcgtctaggggattatattcaaacgttaaacaatgttgaccgagtcgaagtgttgccctaccatacgatgggaatcgtgaaatacgaaaagatggggattaaatatctgttagcggggattgaaccaccgacccacgatcgcgttgtcaatgcggagcgtctattgcatacagcagactatccaaagcagcaacgctaacataagaaaattttaagcctttaataagaatgagcaacgaaaggggttgctctttttttatatctttattattataatgataggcgtaaactaaagaacggagatttgaaaatgaaaacaagacaagaaaatatcttctcctctaaaacattaacctatttcctacagttagcggaaacgatgaattatacccaagcggcacaactactcggtatcacgcaacctgctttaacccaacagattaaaaaattagaacggatagtcggggcgcctttattttattcagtcggcaagaagttacatatttcggatgctggtcggacgatgttggatgctacccatcagattcatgatttattaaatactgcgacggatgaaattcaaagttcaacgagtgcgacgcgcggtaagattaatattgggattttagcatcgatggaaatcagtgttatccaatccttcttaattcaatactataaacaatttcctgacatcgaagtcagcatgcacttattgactcggaaagaaatctgggaccgacttgaaaataataaaattgatattgccattatgtatttgccagatgacagcattaagaactggaaaccttataagtcacataagattgtggatgaacgcttactctttatcagccaagatcctgctttaaagacgcgtaagaagatccgttttaaagatacattagataataaatgggtgacatacccagatgaatactatttaaatcaattcatcagtgaagcctataagaatcaattggttgatcgtccagtgagtgcggctcaattcacatcaccatttgaaatcatgcgttttgctgaagcaactgaattaagtacagctttaccaaagagtttttatgaagcacataatttgggacttaagggaaacgcggttcaatttgatccggccattcagttcgaattagcttttgtcttccgcaaggaaaaggaagatattccacggattaatagctttttccgtgaattcgaccattatttagaagaaaaagattatttaacacggattagagagcaaaaccgtagaatcgtctaatatttttggtataattaggatgttatttttttaaaaggaaggtctgtataaatatgagtaaagaattagtattcggtcaccaaaacccagatacagacgcaattgttgcggcaatggcgtttgcttatcttcaacaacaactaggaaacgacgtagaagccgttgcgctaggtgaacctaatgaagaaacaagctatgcattgcgtcattttgcagcagcaacccctcgcatcattaaagaagcaagcagtgaagttgacagtgtgatgttggttgatcataacgaaagccaacaaagtgttgccgatatcaaagatttaacagtgacgcacgttgttgatcatcatcgaattgcaaacttcgaaacagtcagcccattattctaccgcgctgaaccagttggctgtaccagcacaattttattatcaatgttcaacgaaaacaaagttgaaattccagctcaattagctggtttaatgatgagtgctatcatttcagatacgttgttgatgaaatcacctacaacaactgaaaaagatcggattgcgattaagacattggctgaaattgctgatattgatttcgaatcatatggtcttgaaatgttaaaagcgggcactaacttagatgataagagcgaagctgaattaattgaagcggatgctaaaacattcgatatggctggtaaaaaagtgcgtatcgatcaagtgaatacagttgatatcgaagcggtcttcaaacgccaagctgcttttgaagctgctatcgaagcagacaataaagctaatggttacgacttattcgtacttttgattactgacatcttaaacagtaactcagaagcgcttgttatcggtgaaccagcagaagcctttgaaaaagcattcaacgtaaaattgaacaaccatcgtgcacaattagccggtgttgtttcacgtaagaaacaagtggttccacaattaacagaagcattttaataacgattaataataaagtccttcggggctttatttttttattaggaggataggtaaatgaccgaggaaagcattgatgcaattcaagtgattgaagcgaccattcgaaattgccaaaagagtcagctgaagtttgtagcgggttcggctcaatttactttattaaaaaataggctttacgcattagaagttggtcgtgatttattgaacgggcacacagacataacagtcgaacccttagtcgaggcacaagccccgattgaatcgattattcataaaactgaaaaagcactctctaatcaaaaaaaaacatcacccgtgataaaacgaatgactctattattagcagcgatgactgccgtgcagactgctattataaaccaactatctgcaaaaaagccccctcattaatttggggggctttttttgtgtgccatcagattggaattattctaatctaactaaaaatgtgttataatgtaaatgaattcacaagaaggagcgattgacgatgaaacataccatcaagtttgccttaacaattagtgtgggtgtgattgcgctatgcttggcgtttttgctacatgagccattgtgggcacagattttagtgagtttagcggggagcttagtagcgctctcgatgtttattgagatgattaaaacgctaaaatctggtcaatacggggtggatctattagcgattaccgctattattgcgacgttagcggtcggtgaatattgggcggcattaatggtcttggtcatgttaactggtggcgactcattggaagactatgcagcgcataaagcaggccgtgagttaaagacattacttgataattctccgcaaacagcgcatcgccttgttaatgatgcggtcgaagatgtttcagtcgataagcttcaagttggtgatcaagtgattattaaacctggcgaattggtccctgttgatgggcatattattgcaggaagtgctttattcgatgaatcatcgttaacgggtgaatcacgccccgttgaaaaagcactaaatgatgagctcatgtcaggctctgtgaacggcgatacgtcggttaccatgcaagttgaccaattagccgttaatagccaatatcaagcaattgtacggcttgtagagacctctgcggcacaaccagcgcattttgtgcgcttagctgatcgatatgccgtgccatttacattagttgcgtatgtgattgctggagtagcttggtggttatctaaggatccagtacggtttgcagaagtgcttgtcgtggcttcgccgtgcccattaatattggcagcgcctatcgcgttaatctcagggatgagtcgtgctagtcgaaacgggattattgtcaaggctggcacaacaattgaaaaattagcgtctgctaaatcagcagcgtttgataaaactggaacaattacgaatggtcaattgacggttgaccaagttgtgccagtgattggtatcgcaccaaccgatttattgcaattggcggctagtgcggagcaagaatcttcgcatattttagcacggtcacttgttaaagcggcacaggtagaacaattacaaccaattgaaacattaaaagaagcaacgggcgctggggtagttgcgacgctgtcgtctggacaaacggttcgtgttgggaaacatcaattcgtgacgccagatgcgcaacagcctctgcaagaacaaaccactgtttacgttgcgatcaatgatcaatatgcggggtacattacgtttatcgatcatttacgaccagaagcaccggccacgatgcagacgctccatcaactggggattacgcgtttgatgatgttgacaggcgatcaagcgacaactgcgcaccagattgcggaacaagtcggaattgatgacgtccatgcaggctgtctgccagtcgataagattcatttaattgaacaagtaccgcaagaccaacgcccactaattatggttggtgatggggtcaacgatgcaccgtcactggcaagtgctgatgtcgggattgcgatgggggcccatggcgcaacagccgcaagtgaatcagcggatgtggtgattctaaaagatgatttaggacgggttagtcgtgccgttcaaatcgcgcgtgacacgatgcgcgttgctcgccaggcggttttgattgggattgcaatctgtattgggttaatgttgattgccagcaccgggattgttccagcattagtgggggctttattccaagaggttgtcgatacagtttcaatcttatatgcattacgagctagaacggatcgttaagggaattaaaaagagccgtattaacaccattcaagtgttaatacggctctttttttgtttatttttcagattgtacgtgtaaaaccatgtcttttggtaaatataacttaggcaccatggctaaacaaatacatagaacgatgccggttagaatgaagctagcgataaagctgccaccgttaacagtgagagagtatagccaagcattcatacctttgggagcgtatgagccccaataaacggcaccggctaagaagtggcagaagtattttgcaaaagtaccaacaaatgcggccatccataaaagggtcatcgttttgacttttgtatgattttgaatacttgcttgaataggtcgttgtaagatacctgctaaaccaacaaccatgaaggcaatggtaaattctagcaatccttgccatacgttcaagacactaccgtttcctaatccacgtaagattaagtctagtagaccccagattaagccggagaccattccaggaatggcaccacggcgtaaactgtagattacaatagggataatcccaaaggagacttcgattgcggaaggccccactgtatgggggatgtattccaatgccacggcaaatgccgcgatgattgccccttcaatttgaatcaatagacgctgatgttgcataaaaataaccccttttcttgttcaaccaacacaaaaaaggagttatcatttcaactccatcacaattcctacgcttgtcttaacaaacaggttcgaagggtctgattaaaatcactctcagccaatggctcccctttgcgatggttaacatttaatttttaggaacgctttcagtatactcgatagctggtataagtcaagcaatgtgtaaatcgacgaattgatgtaaaccaaatgactgttagaacgacattgataatcgttgccaagaagagcactaatagtggctattcaagctggtccattgccgagcgttgttcatcagcaacgacgtgcgtatataagtgagtagcttgcgtggtcgtttggcctagttgggtcgcaacaattgtttcactatgagttgccgccatgagatcagtggcaagtgtatggcggaacttgtgtggtgtgagacgcacgccaaatgcttcagaatacttcgcgactaacttttcaatggcatagttgctcatacgcttggcgctgccacgatagcgactgacaaataaggcttgttcattatcttcttttagatagcgtgatttacgaatctggcagtaatcccttaaaaaaggtaaactccacggagcaattgggacagtatcttgctgtccgcctttacggatcacggtaattgtaagttgttcaagattcaaatcgttgatgttggcttgggccaactctgatagtcggatgcccgttgccagcgccagtacacagatggcaatatcgcgttcgcaattttgcttgtatgatgccagttggcgattagaaagcaagttagggtaatcaacttgcatgaaggtgatgaagtcgtgtttcttttcaccggtcagcagttgtttgctgatgtgtcgtgaacgtgtcgccattgtttctgaagctttaagtagtttcaccttcttcatgacgtttcggtaaaaataaggctcaccatcagcttgttcggcttcaatggttaagaagtaccagagcgcatttaatgcgttaatcgagcggttaacggcttgaaaggagagcttatggttattttgtttacgcttattcattagaaaaatcttgtagagctcaatatcttcgagtttcattttttcgagtgcggtcagtggcatctggtcgatagaggggaccgcgacgatctgttcatcaactaaccaggtgaaaaagcgaacgtattcttgtaagtattgatagagcgttgcagaagagtaggcgtttgcctggcggttaatgtagaatttacgaatgtaatccggaagattggcgagttgcttttcgcagagttctaagtaacgttgttgatccatgatggaagactccttaattagcagtttaaagatagtttagcaaaaatgaggtgagaataatacaagtgttgttaaaaccataattttaacaacacttgtattgcaaaccgttccgcaaactgatgatcagatggtcttattcgactatctgcatagcaacctaaagatccttattccgtttaaaagctggtatatcaacgtttaaggccttttttaacgatttgatatgtgagttttaaggctaagatgtgttaatatgcgtatttaccaattaaaatctggcataatcgtcagattaatcacggatttgtgcctgagcttagatgaattctgcatttaaagttaagtttggcgatatcggttggccagtcagtttgattcatcatattggcgttgagtaacttgtaatagtttatgaatcgtgcagtgtaaaaaacaaacgcgttaagtgcggttcatcaaatcaattgaatgatgttggataataagtggttattttagcgctctttcaagggataagcgtttcttcgcataatatatattatgtaaactaaaatagatttaaaaaattaactaagtctacccactcgtcaccagcgtttaagcgcagcaaaaaagcgccatattaaaatgatgcttctgtaattagtgatttaaaaactgagccaacaaagctgcaaagtcatttggattttggaataacgcatatgaccagcatctgggtaaagttttaattgggaatttaaaatccgttcatgtaattcatatgaaccattaacaggtaccattcgatcgtgatcgccgttgacaatcaatgttggttggttaatttgtgccaggtttgccggttgatcgtgcgcatactgtttaattgctattaattgacgacgataagcggctaacgtaatggctttatcttcaacaatttcacgctgttttaaccggttaatgaacgctttaccagcctgtttgccttggggcgttctggtgaagaagaggtattccttaacgtctctatgcgttaagaaggaccgaattaagtcaaaagttgttatgcgccccactttggcgatttctgagtcaccctggggacctgttccgactaaaattaagtgattaacgcttgaggggtattttaaagtgaaggcctgtgcaacaaaaccacccatcgataatccaagtaaatcgaattgagtgagctgcatagctgttataaaagcataacaatcagctaccatttgctcaatcgtcgtggggactttgccatccgagaaaccaacaccacgattattaaagacaatcacgcgtcgttgctgactgatcaggtcaattaatgcagggtcccagttatctaaagtggctgataagtgattcaataaaacaagtggtaagccgcgaccggtacccacttcgcggtaagcaaaccgttggccttgttgatcttgaataaattggttgggggttgttagataagtcatcttgattagcccgcttgaaccttaatcaccactttaccagttggatggccgtgagcaacaagttctagtgcctctttaacgtgtgctaaatcgaattgatgcggatcgatggctggtacaatcgcttgttgttcaacaatttcagtgatttttttgagttgggcaccatctgaacgaacgaaaataaagcgatattcaacgcccgcttttttagcgaggcgatcccatttccgcccggccaacgagaataagagttgcttccaaaatggtaattgcaattgtttagcgaattgtttgtttggaccggcaatcaagcttaaaatccgcccgcccggcttcataatcgccatttcacgttcaatatctgctccaccacgtgtatcaatcacgtaatcgatttgatctaaaacttcccagtaatcggttgttttgtaatcgatatattggtcagcacccaaattcaaaatgtgatctcgcgcggctacattgcctgaaacaatcacggttaagcctagtgattttgcgattgggacggctatttgaccgaaaccgcctgaaccaccagggataaacagcgttcggttcggttgggctgccaattcctcaaatagcccctgataagccgttaagccagtcagtgggattgcaacggcttcacgtagcgataaatcctttggcgtgtaccagattgcatcggtggtaaccgcgacatattcagcaaagccaccgattttagccaatggtaaacgcgcatagacttgatccccgactttgaaatcagtgacgtctgttccaatcgctgtgatttcaccggcaatttcattgcctaaagtcagtggtaaagcatagttttgcattaatttagtatcgccgcggatattcattggatccaatggattcaccgctgcataggcgactttgacgagtacttcattggctagcggttgtgggcgatcaatttcttgaatcgtgacagctagtgtttgattatattttttaatttgagctgctttcatattagaaaacctctttccacgggagtgtttgtagggtttgttgcacaattgctgttagcgtagttgaatctgggttcactttagccatgacccggataccaatgagcgcactttgaagcgatgcagctaaaagatcaattgcaacagacggttctagttcggcctggccggcaatcagtaatgcctgcaacagtgctttttcttgggttaaataatgctgaatcagcgtttggatgtctggttctaatgaatttaacgttgccgcggtattcaccactaagcagccggctggttggttatccggatggtcaataaatatttcaaaaatggctgttaagcgcgaccttaaatcggtatgcgttgccagtacttgctcgaaacgctcgttaatttggtcacgataatgtgctagtacttggataaacagttcatgtttatcgccgaatgtatcgtaaatactgcgccggtgaatccccattgcatcaactaggttttgcattgaggtattctcatagccttgttgccaaaagacaagcatggctttgtctaagacaaccggtgcttcaaatgtttttgtccgcatctggatgctcctctcttattagaacgttcattctaatataaacgattctttgaaataacgcaactagattttgcgcaattttaaggggcaataaaaaagaacgcctcgaatgagacgttcttgtcagctgttattttgtccgatagaaaataccaaacgcccctaggccaacgtgactcataatgaccgggctggttagtgcgactgtataaggcacatggggctgtgtttcttcaagcgttgcttggatcttagcggatagttcatccgtgattccgacgtgtgagatgccgatttccgcaacgtcttgggtggctaagtattcacggatattgttgatttcttttgtaaaagcttttagtccccgcccctttgcgacgacttctaattccgtatctgttaagcgcacaattaccttgagtttaatgattttcgttaatagcccggccgttctactaattcgaccaccgcgttgaagcgcgtcaagtgaatctaaaaagacgtaggtttcggttttacgacggatgtcatcgagatgcgcgataatatcatcaagaggcttccctgcttcaacgtcttgggcggcagcaaccacttgataagcaagtccacggtcgattgctttactatcaatcacgtgtacgtcacttgttgattggtgggctgctgtgtgtgccccttcgattgtgccacttaacaagccggtacaatgaatcgatagaatcgtactaccatcagcccctaattgatcatataaatcgacgaaactgccgacagttggctgacttgttgttggaaaatcggtcgttgcattttgtaagcgacttaaaaattcagcgcgggtaatggtttgtccatcaatgaaagactcatttccttgttgaatcgttaaggggacgatgtgaatgtcatatttggcgcgttcgtctgctgtcagttgaatcgatgagtccgttacaattttaattgtcatatgagttgtactccttcaagttaaatgttgagataaattgaaaaaaacatcagggtcgttccgagcattacgaaaaagtgccaaatcaaatgtaagccaggaattttaggaaaactataaattagagcgccaacggtaaagactacgccaccactgactaacagccaaaaaccaactggactgaggttgacataaagggtcttaccagctaataaacataaccaccccatcacaacgtaaatcgttgtttcaatcttttggtaccgaccgtggctcaaaatgtgcgttataataccggcaatcgctagtgtccagattgcaatcagtaagctaattcctgttgcatggctaataaaaatcaaacaatatggcgtgtaggtaccagcaatcagcaagaaaatattgctatggtcgaatatttgaaacacgcgcttggccttggtaaatgctaagcagtgaaataaagtcgaagcgagatacagtagcagtaatgtggcgccatacactgctagactagcaatcgcgactggtgagagtgttttatgaatgcttttgaccaggagcatgatgactaacgttaaactaccgaaaaaaccaatcccgtgggtaatggcattccatatttcataaatcagttgttgtcgtttaatcgtggaaagttgcatggttctcgcctctttttctctatttgccgagtattatagcgcgaatgtagattataagtcaatagataatagaattcgattctatgttagtgacaaatgataattgctatggcataataaatatactatcaacagattggtggcgttaatcagtatgcaatcacaagaatttgaaaaatggttgggtgactttcaacaattgcggttaccattatggtctgaatttccagatttagacctctatatggaccaagtcattagtgaggtcaataaacgactgagtcctttgttggacgttaaaataacgaaaacaatgattaatagctatgtcaaaatggcgattattgaacgaccggaaaagaaacgctataatcgggatcatttagccgaattgattgtggtcagcattatgaaattagtcttcccgctcgatgtcattaaacaagggatttcgcaatcgttggcaaacgacaccgctggtaaggcatatgatcagtttgtgcggttatttaatgccgaaattgcgaatattaacgcgcaatcaacggttaatgaattcaatttaaacgaggaaccgctcaacattgttcaaaaagtagccgttaaatccgttatttataagctaattgggacgaagttggttaccttagaagaacccgtttctatcttataagtcacaaaaaaagcctgtcgaattgttcgacaggcttttaaattaggctttatcaaaatctttaatccaagcaagtgcaatggctttttcaccaagatgggtcccgataactgggccaaagtagctgatatcaattggtaagtctggatagtttgcttgaagcttatcacgccatgcaatcgctgctggttcatcgttagcgtgaatgattagtgcgcgtaatggatagtcaacacgttcggctgtttcagcaaaaatttgttcagcgcgggcgtaagccttcttcaatgaacgaaccttctcaaatgccgtaattttgttagtgtcagcgtcaaacgttaaaagcggtttaatcttcaacatgctaccaataaaagcagatgcgtttgataaacgaccaccacgcactaagttttgtaagtcgttaacaatgaaacattcatccattgtgctttttagatcgtcaaggcgtgcgataatctggtcgacggtcacttctgggtcgcgtgccattctggccgcttccatcgctaagtagcccattaacatcacagtaatccctgaatcgtatgggacaacctggatgttatcgatggtgcttgccgcatttttcaatgtcgtgacaaacccagagatggtactagcaaggtggatgctgatgacagcatcatacccttcgttgccgaggtcttcgtatagttttaacatttcacccagtggtggttgtgatgtactggggaatgtttcggatgtttttaatttttgatagaactcttcagtggttatatcaacgccttcatcatagacctggccatcaaggataaccggaataggtacgacgaagagatgatggtctttcacttgctgttctgtgagataagcggtactatcagtgactacagcaattttcatggtgacacctacttttttattattcggtaataactatatcataaatggtaggttaattcccctaaaaatgccgattttccgaaaaatgtatagggcgtctcattttaatggtcgattaaagctttgataataacggttcagtaggatttttaaaagttgctgttcatcggtactccagttttgttgaatgtgattttcaagttcagtttgaagttgttgcaacgtacttaatgccgttttggcggtcggtgttaatgcgtaaacgcgttggcgcggatcagccccggtcacttttgttaacagcccttcttgagccatcgtatttaactgccgactgagtgtcgatgcatcgagtttggttaacgtagttaattctgcgtgcgaaatgcgttcttgatcgggttcaatggccattagaatattgacttgggctaacttcaagtcgagtcgtagcgcccagtgtttcttttgttcttgatacaatagattcagttgattaaacgttgctaaggttgagcgcacggtaaatccccctttaattgtataaagtaatttgataattgtattatacaatagtcgtattagcgattgcaaacaactaatttctttgaggttccactgcaaaaccgttacaataagtaagacaattcaattatagagagtgtgagcaataatgacctttgatggtttaatgacccacgccgttgtaaatgagctaaatacaactttagcagacggcaaaattacgaaaattcaacaaccttatccaaacgaagtaatcttaacgattcgggcaaatcgtaagacctatccccttctcctatcagcccacccatcttatgcgcgagtgcaagtgacgcgggtgccttatgcaaaccccgcaacgccaccgaacttcgcgatgtctttacggaagtatttagatggcgccattttagaaaacatcaagcaaattgaaagtgatcggattctaagattcacatttaaatcacggaatgaactgggggacttacaacaactatgcttaatcgttgaattgatgggccgccatagtaatgtgattttgattaatcaagcgaccaataagattctcgatttaatccggcacgtcggtgtttcgcaaaaccgttatcggttcttaatgcctggtgccgattatgttagtccaccggctgcaaccggggttgatggttttacgactgatttaaagacgcttgattggttaagttattataacgaagctgctgatgaacaagtcaaatggttacaacaacacttccaagggatgagtcgtgaaagtgccgttgaactacaaacccgtttaatggatcatgacaattatttggcggttgtgactgatttcttcaagcaattcgaccaagtgacaccaacgttaacagttggtgaaaagaagtcgtggttcacggccttcccttatgagagcctgacagggacactgagccattttgacacgttgagtgagctgttagaccaatattacttacacaaggcgcagcgtgaccgagtgcagcaacaaggtggtgcgctcatccacttcatccgcaacgagattcaaaaggatgaaaagaaactgaaaaaactacaaaaaacgttaaaagcagccgacagtgctgatgattaccggattaagggcgaaattttgaccacctatttgcgggaagtcgaacgtggcatgactgaagtcacgttgcccaatttctacgacaataacgaaccgcttaagattaccttgtcgaaccagattagcccttcaaaaaatgcgcagaagtatttctcgaaatatcagaagctccggaattcaattgcctacgtcaatgaacaaatggcaaagaccgaagcagaacttgcctacttcaacacgattatggcgcaaattgaaattgctgaacccaaagatttagaggatatcaaagctgaattacaggctgaaggttatttaaaggctaagaaaaccggtgccaagaagcagaaacgttacaagattagtgaacctgaagttttctatgcgagtgatggcacccggattttcgttggcaagaataactatcaaaatgatcaattaaccttgaaaaaagcccataaaactgatatctggttgcatgtgaagaacattcccgggtctcatgtgattattgatagcccagatccatcagaagatacgcttcaagaagccggcaacttagcggcctacttctcgaaggcgcgcttatcagcggccgtgccagttgattatattcaggttaagaagattaaaaaaccgaacggtgcgcgaccaggatttgtgatttacgaagggcaacaaacactttatacgacaccagacgagcaactcgttcaaaagctacgtaacaaacctgtgcaagactaataaaaagcgttactccaaagtgaattggggtaacgcttctttgattggtgcggctgatggcacacgctaaacgtgttctgcaagccattactttccggttaacacgctattctaatgggcgtctgaccatgcttgtgggtcttggcgccattcattgagtgatgtggcttgttctggagttaagttatcagcggcttcttcgaccgctaataaggcggagaaattcgataaggtcgttagtggtaagttagcagttgcgaaattctgttggccggctgccagttcgtatgaaaagatgccaaaaataccaaggacttctgcgccctctttttgagcggcggccgctgcttgtaagacactcccgccggttgaaattaaatcgtcaatgaggactaatttttgaccggctttaaacggtccttcgatttgacggccttgaccgtgatctttcggtttcgaccgaatgtaaaccatcggtaagtcgagttcggctgcgacccatgcagcatggggaatccccgcggttgctgttccgccgatgacttcaacgtctgggaattgcgctttgattgccgcagctaagttgctggcaatgagcttgcggacttttggataaccaatcgttaaacggttatcgcaatagatgggacttcttagcccactcgcccaagtaaaagggttgttaggactgagactgacggcatgaacatcgattaaggcttgtgcgacttggtgtgcaattgttgtcatttgaaagactcccattctgatttgatagcttggtaagcttgatatggatttgtagcttgcgtaattgggcgcccaacgacaatcgccgagctctcagcttgtgcggcttcgtgtggtgttacagcccgtttttgatcattggtttggcttgttgctggccgaatcccaggtgtgacgcagagaaaatcagcattggtgtgttcgcgaatcgttggcacctcttgagcagaacagaccacgccatcgcaatccgagttctgtgcgagttgcgcatagtgtgcgacagattctggtaggctgacattaacgagttgttcggtttgcatttgcgcttcgctggtcgacgtaagctgcgtaatcgctagtagtttagcgggccgcacgttgccaagtgcggcgccttttttcagaccagccgcccctgctttgagcattgcctgcccaccagctgcgtgaatcgttgtgtaatcgacaccgagttggccgataacagtcatcgcgctttgaacggtgtttggaatgtcatagagttttaggtcgagaaaaatccgatagccgcgcgcttttaacgttttaatcagctgtggtccctcttggtaaaaaagttccatgccgactttaacgaataaggattcatcagttggaaattgcactaaaaaacgatctgttgtttcccagtttggaaagtcgagcgcgataattaaagggttagtcatgagtgccctcctgtggtagaccgaatgattttaaatcggttagttgatatttagcgagttcatctggtaatgcggcgattagttttggacaggcaaatggatcgctgaaattagcagtgccgactgcgatggcattggcgccggcggccattaattcaagtgcatccgcagctgttgagacaccgcccattccaataatcggtaatttcgaaattgaacggacttgatgaatgagccggatggcaacgggttttatcgctggtccagataagccgcctgtttgattagcgagaattggttggcgtgtttttggatcaatccgcatccccaccagtgtattgattaatgagaagccggctgcccccgctgcttcaactgcttgcgcaatcggacgaatatccgtcacgtttggtgagagcttcacgtaaaccggcacttggctgactgcaacacaggccttcgtcaacgtggcagcggcttctggtgatgtgccaaattcaagaccgccatgggccacgtttgggcacgagatattcagttcgatggcatggacgttgggcgcttggctgatttgttcacagacagcgacgtaatcagcttcggtattgccggcgacattggagatgattggtaactcgggataatgctcggctaaccagggtaatttttcttgcattttgaagacgggtccgtcatcgcaaattttgagctgaatgcttggatcacgtttgagtttggtgacacaggcgtagcaggcaccaatcccacaagccatccgttcttccaatgagatataggcattgggatgctcactgaatcgattatcgacggccattaacaagccttttggtccgcatgcgtaaatggcatcatatcgggttgtcgcatcagcaaactgtgcatcgagtaataaaccaacatggccttggtagccgtacgagccatcatttgtcgcataagcgactggcccgagcttgcgaaagtgatcttcatagaaaatggctgctttagttgcaaagccgaacacgtgttgaacgtgaacgccttttgcattaagttgccgtgagagttcatgtaatggtggaatcccagtcccgccaccaatgattagcgcgttttgtccggctactaattggtcaattggataaccgttaccaagaggccctaagacggacaagcttgtgcccaccggtgattcacttaagatcgtggtgccttcaccaacaacgcggtataacaaggtaatcgtgttagtttggcggtcgacattggcaatcccaaatggccgacgtaataaaagggcgtcactggggattttgatatcgacaaattgtcccggtgcaatgggttgctgtgcgaggtctccggtgaggcataattcatagatactgggggcaatttcggtttgcttagtgagggttaattggtattctaatggcaacatttagcagactccttctgatttttatgtaataaaagagccttaggcaaagggcttcagactcttttagtggttttaaagtggtttggtcaggagcgattgagattctaggaccgctaagatcgcatcagcggtatccaatgaggtcatcaatggaatgccgtgttcaatggcggtttggcgaatgacgatactgtctttagcgacttgtggggcttcgttcaagccggttgtgttgatgaccagttgaatgtggccggctttgattttatcaagtaaatcgccgctcgtagcattaatcttggcaacggattgcactggcacacctgctgcttggaattcttgactagtcccaggcgtggcaatgatttgatagccaacttcgcggaagcgttttgctaattcgagcgcttgtgtcttatcttggttagtaattgtcattaagacgttcccgtgacttggtaagtgcatcccactagcttcgaacgctttatagagtgctttttgcatcgttacgtcagttcccatgacttccccggtcgatttcatttctggcccgagtaagctatcaacccgcgtgagtttcgagaatgagaagacaggtgctttaatatgaattagtgggcccgctggtaatagaccggttgggctctttaattcagctagtgtgctgcctaaaatgacttgggtggccagttgcgccatcgagatgccggtgactttactcaagaatggaacggtccgactagcccgtggattgacttcaatcacgtagactgcttcattttggataatgaattggatgtttaacaagccgcgacattcaagtgctaaacagagcttggtcgtgtaagtgatgatggcttgtttttccgcatccgtcagattttgtggtggataaaccgccattgaatcgcccgaatgaacaccagcgcgttcgatatgttccataattcccggaattaagacatctttgccgtcacagatggcatcgacttcgcattctttgcccattaagtagcggtcaattaggaccggttggtcgactgaaactttaacggcctctttcatgtaatgtgtaaggtcttctgcagtatgaacgatttccattgcccgcccgcctaaaacgaaactaggtcggattaagaccggataaccaatctcttcagcaatcttcaacgcatctggcgtattggttgcggttgccccgactggttgtggaatgtcgagttcggcgattaattgatcgaattggtcacggtcttcagcgcggtttaagttcgcgacgcttgtcccgagaatctgcacaccattttcggtcagtggttcggcaaggttgatggctgtttgccccccgaattgcacaatcaccccttctggtttttcgagttcaacgacgttgaggacatcttctagtgtcagtggttcgaagtacaatttatctgaaattgaaaagtcagtcgaaactgtttctggattactgttcatgataattgcttcgtagcccgccttttggatggcttgcacacagtggacggttgcataatcgaattcaaccccctgcccaatccgaattggaccggaaccaatcactaagattgaaggctttgtgctgacaatgctttcgttttcttgttcgtaagtcgcgtagtaataaggtgtttgtgattcgaattcggctgcacaagtatcgaccatcttataaactggctgaatgccactttcttggcgcatttggcggacttgggcaggcatgatttgccaagttgcggcaattttagcgtcggcaaagccatttttcttggcgagttcgagtaattctaagtcacctttatcggtccggagttgttcttcaatttcaacaatgtggctgagtttatccaggaagaaaagatcaatttttgtcaattcactaagttcttgaattgaataaccgcggcgcaatgcttcggcaaggtagaaaagtcggtcgtcttggggatgtacaatccgttggacaaggtcgttatcaccgactgccgtcaatgctggaatttcgagatggtcagtgccaatttcaagtgagcgaacggctttgagtaatgcttcttcaatgttgcgtccaatggccatcacttcaccggtggccttcatttgggtgccgagttgccgatcacctttgttgaatttatcaaatggccaacggggaatcttcgcaacgacgtaatcgagcatcggttcaaattgcgcataggttgtcccggtgattggattatgaatttcatcaagtgttaaaccgatggcgattttagccgccatttttgcaattggatagccagttgctttagaagcaagggctgatgaacgactcacccgtggattgacttcgataatgtagtagcggtcgctattaggatcaagggcgagttgaacgttacagcccccttcaatcttcaaggcgcgaatgattttaagtgcggcatcgcgcaatgcttggacttcacggtcacttaaggtttgaacgggtgcaaatacgatggaatcgccagtatgaatcccgactgggtcgaagttttccatgttgcagacgactagcgcgttgtcatttttgtcgcgcatgacttcgaattcgatttccttgaaaccggcaatactttgttcaacgaggacttgtccgactggagataggctaagcccgtttttgacaattgtgctcagttcaccggcattttcggcaatcccgccaccagtgccaccaagggtaaaggctggacggataatgaccggatacccgttttcgttaacgaatgtttgggcttcaacgagtgaatgggcaatcgcagattctggaatcggttcgtttaactgattcatcaagtttttaaacagttcgcggtcttcagcttgatcaatcgcgctgagcttggtaccgagcaattcaatgttcagctcggcgagaatcccgttgtttgccagttccaaagccatatttaagccggtttggccgccgagggttggtaagatggcatctgggagttctttgcgtagaatttgcgtgacaaagtcaatcgtgatcggttcgatataaaccgtatcagcaacggctttatcagtcatgattgtcgcaggatttgagttaattaaaacgacttggtagccttcttctttaagcgctaagcaggcttgagtgcctgagtaatcaaactcggcggcttgaccaattacgattgggccagagccaatcactaaaattttatgaatatcggtacgttttggcatcactaaatcccctttttactatttttggcggcgattgaagtcatcgatcatgtcgataaattcatcgaatagatgtgcagcgtcgtgtggaccaggggctgcgtctggatggaattgaacggaaaaggccggatattgtctatgacggagaccttcgactgtttgatcgttaatttcaacgtgtgtaatcagaaggttttgtgggtcgatggagtcggcatccacggcgtacccatgattttgagatgtgaagtcgatccgtttggtggcaacttctcggaccggatggttgaaaccacggtggccgaacttcatcttgtaggttttagccccattggcgagggcaaaaagttggtgaccgagacaaatcccgaaaatcggcactttaccttgaatccctttgatcatttcaatggcttctggcacatcttctggatcaccagggccgttggttaacatgacgccgtctggatcgagactcagaatttcttcagctgttgtgttgtatggtaagacagtgatgttacagtcgcgttttgacagttcacgaaggatactatgttttaagccaaagtcaatcacgacgatgttccgcccgttagcaggactcggataaggtttggccgttgagacttgttggacttggttttttggtaagaccaatgccttgagttgatcgaacgcgtgatcgtctgcggcatcaacgatgctggctttcatggtccctttatcgcgcagacggcgagtgagtgcccgcgtatcgatgccggcaatcccaggaattttcttttgctttaaaaagtcatcaagactcatattcatccgccagttatttgctaggcgtggtgtttcatggacgacaacccctttacaggttggtttaatcgattcaaagtcgtcgcggttgaccccgtaattaccgattaaagggtatgtaaaagcgatgatttggccgttgtatgattgatcagtaatggtttcttggtacccactcatcccggtgttaaagacgatttcgcctgtcgagataattggggcgccaaaaccggtgccggggaagatggtgccatcttctaaaataaggtaacgtttcatcttttagttcactccttttgatatgcaatctgaccagcaaccaaggttaataaagtatcaccttgcactgcttcgccgataaatggcgtgttgtggcctttcgataagaaagtgtttgcgtcgattgtggtggtatccgttaaattaaaaacagcaaggtcagctggttggccaaccgctaactggccggcgtgtggtaagttgaaaacatgggccgggttggttgttagccagcttgtcagttgcgcgagactaaatggaccgttggcaactaaatgcgtgtatagcaagctaaaggctgtttcactccctactataccaaatggcgctttcaataacgcctgttgtttctcttctgtggtatgcggtgcgtgatcggtcgcaataatatcaatcgtcccatccattaagcccgcccagagtgcttggcgatctgcaagtgttcgaagtggcggattcattttgagcattgcgttgtcactggtaatcgctgaatcatcgagtaacaaatgatgtggggtgacttcgcaagtgacgttgaggccatcttgttttgcgcggcgaacgagattgacggtttccttagttgagatgtggcagatatgataatgaacgccggtcgcccgcgctagctcgatatcccgggcgacttgggcggattcactgacactcgcaattccgggaacgcctagttttttagcggcttgaccgtcgtgaatgacgccgccgttgacgagtgattcatcttcgacgtgcgcgacgatgggcatgttaatctgggcggccatctgcatcgcttggtacattgtttgtgccgtttgtaccccatgaccatcgttggtaaagcctgctgcaccagctgccttaaacgccgacatgtcgacaattgtttgttcagttaactcattggtaatcggtgcaaattgatatgtgtggacgctggtttctgcctgattgcgtgcaaccagtgtcttgaaatctagcaagttatcaggtacgggctttaagttcggcattgcaattacgctagtaaaaccaccgtgggcaaccgctgcgctccctgttttgagtgtttcttttgtcgtgaagcctggatctctgaagtggacgtgtccgtcgattaagccggcactgacgaaatggccgtgtgcgtcataaatcgtttctgggtcggttgggactgcggtaatcgttggttcaattgccgtaatctgaccggttgcatcgatggcgatgtcgcgtttttgcagttggccgtcaatcaagacttggccgtttttgatcaattgatacatagcagatccccctcttaatgttgaatcagatgttgttggtctaataggtgttcaatgatggccatccgcataaaaacgccgttggtcatttgtttaaaaattcgcgattgtggggcttcaacgagttcgtcggcaatttcaacgtcacgattgacgggtgctgggtgcaaccagatagcactggacttaaggtgtgctgcccgctcagttgtcaaaccgtactgagtatggaatgcagtgtcagataaggtttcatcggcagcaaagcgttcgtgttgaatccggagtaacatgacgacgtcaacttctggtaagacgtcatcgagttgggctggttgtccgtattgggcaaattcaggggcgaaccattcctcagggccggcaaaatacaatgttgcgccgagttgtttgagcagttgcatatttgaccgtgccacccgggaatgacgcaagtcaccacagatgacgacttttaagcctacaaagtggccgaactcttcgtgaatcgtcattaaatcgagtaagcattgggatgggtgttgcccactcccatcgcccgcattggccagtgccatgtggaattgatcatctgcgagtaaggcgtcgtaataattattctgagaatggcggacagcaacgaaatcgacgccaatggcttgtaccgttttgagcgtatcgctgagggtctcgcctttggaagtcgaactcgtatcggcattgaagtctaagacggtcatgccgagtttgcgttctgccatttcgaaactcgtatgggtccgtgtgctattttcaaagaataggttcattgcgtagaccggccgagttaatttgcttgtcgcgccctttttaaaggcgctagcgcggttgatgagacctgcgactaaatcattggtgagttgatcaacggaaaccaacgcgttatgcttttgcattttgttgagcctccaattcaagttcgctctttgctttatccggtaaaacaaggtttaagacaatcccaaggacggtggcgatggctagccctgagaattggtattggcctaattgtaagtaggcattgccaatcccgatgacgaggattgatgaaccaatcattaagttgcgtttcttatcaaaatcgacttgtttgtcgattaagacgcgcaaaccgcttgaggcgatgaccccgaagagtaagaagctaatcccaccaattacgggtgtggggatgctttgaatcaacgcgctcagtttgccgatgaagccgaagatcatggcgaagaatgcggcgccacctaagacccagacactgtggactttggtgatggctaagacaccgatgttttcaccataacttgtgacgggcggtcctccgacaaaagcggcgatgattgaggctgtcccgtccccggctaacgtgcggtgaagaccaggatctttaaagaagttacgcttggtgagtttgtttaagaccataatgtggcccatgtgttcggtcattgtgacaaaggcaattggtgccatgctgagaatcgcgccccagtacagaccgggtttgtaagtgacaaatgggacttggaagtctggtactttaaaccaaggggcgtccatcacgggttgaaaatcgacgatcccgaacaagacggcgatgatgtagccagcaatgatgccgagcaagatggggactaagctcatgaatcctttgagatacatattaaagccgatggtgattaacaacgttagtaaagcgactgcgaagaattttaagtcgtaattcccgtgggcattgatagtggcttgtttggcagctgtgccagcgagtgataagccaatcaccatcacgattgggccgacaacaatgggtggtaaggctttgtcgatccagtcggaaccaatcagactgactaagattgaaacgattaagtagactgccccaaccgccattgtcccttgtgcaatcccagggtagccagtcgttttcatcaaagcgagcattggcacgatgaatgagaaactcgaccccatgtatgctggaatcttgcctttggtaatcaagaggtacattaaggtgccgaccccggaactgaataatgcaatccctgggtttaaaccgactaagattggcactagaacggttgagccaaacattgcaaacatatgttgaatggataaaccaatccatttaccggtgctggggcgttcgttgacgtctaagaccgcatcgggatttctaaattgtgtagccataagtatttcctccatgtcgccgactttttgaaccaaaaaaagacacacgctccaacagattggtaggtgtgtcccttgacggacttaggcccctttttttaggcgcactaagttcaagacaaacccttttgctctctctggagacaattaaacggttcagtcgttatttagttagtttttcgatggtaatcccatcatgttgatcaatttcttccatcgcaacgcgaatttgttcgttgagggcggttggaatatttttaccgacaaaatcggggcgaattggtaattcacgatgaccacgatcgactaagacagccaatgaaattttctttggccggcctaagtccattaaggcgtcaagcgcggcccgaatcgtccgccctgtgtaaagcacatcgtcgattaagatgacatgcttatttgtgatatcgacgggaatatcgctcccgttaatctgtggttcattttgtgcatcaagatcatgttgatcatcgcggtataacgtaatgtctagtgtaccgacgggcaatgcgatgccttctaattgttcgaggcgttctgcaatccgttgggcaataaacacgccacgggttttaatgccgacgaggacgagatctgaaatccccttattctgttcgataatttcgtacgtaatccgagtaaagacccgtttcattgtgttactgtcgaccacttctttgaccatcgtaaagactccttccaaacaaaaaacctctcaaaccgataaggtcgagaggttacagttagagactccgcgtctagtggtgctttcaccgtaccttctcggcctcacgggaccgattttaaaggcttctattaagttagacctagcttaacggagaatccttgatttgtcaatgattttcacgtaattcggttaaagttttctcgaagattgcgggtaatggggcttcaaagcgcatcatttcgcccgtcgttgggtgcttaaagcctaatacagcagcatgtaagaactgaccatgcccagctaaagttttgcggggaccataaacgggatcgccagcaactggccggttaatataggctaagtgaacgcgaatttgatgggtgcgcccagtttctagtcgacatttgattaatgtgaagtcttcaaaccgttccatgaccgtaaaatgcgtgaccgctgggcggccatcttcgacgattgcttgtttcatccggtcgacttttgaacgaccaatgggtgcatcaatggtcccctcgtcttcttcgatgttgccgtggactagcgcgatatattcacgtaagttttccttagctttgagttgggcggataaagattcgtgggcttcgttggttttagccaccatcaaaagaccagaggtatctttatcaattcgatggacaatccccggccggaagacgccgttgatttcagacaatggggtgtgcgccaataaagcgttgaccaatgtcccattcgggtggccagctgatggatgaaccaccatcccttgtggtttattgactacgaggacttgatcgtcttcatagacgatatcgagcggaatatcttctggggttaagtcgagcgtgacagggtctggaatattgacggtgacgacatcccctgttacgactttgcggttactcttacaaggttgatcattgacttgcaccaagtcttttttcaaccattgctggatttgtgaacgtgagtaatcgggtagtaattgggtgagcgccttatcaatccggcctgtttcagttgtaatcgttaattgtttagtttcagtcatgagtcactttctctttcaacaaaatagcaataaagacgcagatgacgcctactgttaaggcaacatccgcaacgttaaagatggggaaattaataaattcgatttggaacatgtctacgacgtacttaaggtggagccgatcgatgaagttaccaagtgttccggctaacagcaacgttaaaccgatccggtaaaatttttcagtgcgatcagaggtataaaataagtagccaattaccccgagggccacaatggtgacgaggtagaaaaaccactgttgaccggccaagatactccacgcagccccatcgttttgaacatacgttaaactcagtacgttcggaataacgggttgggttgctgcaaaggcaacatgggcaacaatccagctttttaaaagttggtcaccgagtacaatgactgcggctaaaacgatatagatgagcatgggaacctcctattcatacaatctaccattgtccttaaaatcggctgacttgtcaatcagttttcgagatgggcgttaggatattggaaaacgtgcttttcaagctaactttctgcgcttaaccaaatttgccaaatcgccgattgtatcggcaattcgtcaaattctattaatgctcagaagctaaccgtttcaaacgcactctagaataatccgctaatcaggccatcttctgtgacgtccatgttgagggcggctggtttctttggtagacctggcatggtgaggactgtgccggtcattgcgacgatgaagcctgcgccaagctttggaatcaattcacggacgtgaacggtgaaatcagttggtgcgcctaatgcttttggatcgtctgagagtgaatattgtgttttggcgatacagactggtaagtggtcccagccatttttttcgatttctttcagttggttgatagctttgccctcgaaaacaacctctttaccgccatagatgtcagtgacaattgtggttagtttcgattgaatgtcggcgtttgaatcatataatggttggaagtttttaggttgatcgagtgcttctaagacggcctgggctaaatcaaggccacctttaccaccatgtgcccaaacactagctaaaacggctttgacacccagttcagcacatttttcttggagcattgtaacttctgcttcggtatcacttgtaaactcattgatggcaacgactacgggaacgccgtaacgttgcatattagcaatatgtttggctaagttactaaaccctttgtctaacgcaccgagattttcagtggttagatcagctaaagcaacaccgccgttatattttaatgcccgaacagtggcaacaatcacgatggtatcaggagtcttgccaagttgtgggactttgatgtctaagaatttttcagcacctaaatctgcaccaaaaccagcttcagtaatcgcaatatcacccatttttagggccgtttgggttgctaaaatactgttacagccgtgagcgatgttggcaaatggcccaccgtgaatcaaggctggtgtatgttcaagggtttggacgaggtttggtttgagagcatcttttaaaagcatcgcgattgcaccggtgatttcgagctggccaactgtgacgggttgccgatcataagtgtaaccaatgacgatttggctaatgcgccgcttcaagtcagtaatgtcagttgctaagcagagaatggccattaattcgctagcaacggtaatgtcaaaaccatcttggcgtggcatcccttgcactggaccaccaagtccaataacaacttggcgtaatgcacgatcattaatatcaagcgcccgtttccaaataattcggcggggatcaatgttgagggcatttccctgttgcagatggttatcgattagggcggctaaagtattcacagcagcggtcaatgcgtgcatatcccctgtaaaatgtaagttaatatctgccattggtaccacttgggcatagcccccaccagttgcgccacctttcatccccatgacgggtcctagtgaaggttcacgtaaagcaatgacggctgattgatctagttgacgaagggcgtcgccaagaccgacagtcacggttgacttaccttctccagctggtgtgggattgattgaggtcactaagatgagtttgccatcttctttttctttcaatcgattaatggcagcgaaattaatcttcgctttatacggtccatactgttctaaatcagcggccgttaaaccagcttgctcggcaattgccgtgactggctgcatcttcttagcttcattttcctgtgctatttgaatatctgacataccgcccagctcctttttatttatgatactacttagtatagctgattacgtacggaattggcagatgggatgcttaaaaagaacgatattcttcgacacgcttctttgtacgtggtaaaataagcgcgtacgctgattaacatttcaaggagggattgtgatggaacgaggaatcgttaagtggtttagcaatgctaaaggttatggcttcatcagttatggagatgacgaggaggttttcgtccattttaccgcaatccaaaccgacggctataaatcattgaataaagacgagccggtattatttgagattaaagaaggcgcccgcggtttgcaggcagctaacgtgcaaaagatagcagaataaaaatacgtttaaacgctaaaaaagagccacgacaagattaatgtttgtcgtggctcttttttatttaactattctttaattggccaaccattttgtttcagttgttcaacgaatgcctgtttggctttgcgactaaggagtatttgttcgggttggtaatcaagttcgttggttttaattaataaaccatgtttttggacaataatggccgtagtcgtttcacggttgatggttcgattatatttaaataccggccgtttaagcgtgatcacgtctgccgtcattgaaacgcgatgcccgaaaatgacccatagcgtcaaacaaacggctattaagccgatgccccacgattgccagtttaagttgatgagttcaagttgtacaattaaagctaatgtatagacgaagccaatccaagaccaaatcgtcacgaagtaagcataatttggttggtagaatgcggtggttgtcttttgcatgggaacactcctttttacgctttgtatcataccattaacctgaccctgctgtcagtgaaaggcggtaaattttaagaatgattaaactttatacggacgcagcaactcgtggcaatcccggaccaagtgcggcgggaatcctaatcgtgacaccagagcgacaatatcaactgcaagcacctttgccagaacagtccaatcatgatgcagaatttgcggcggtcattcttggcttagaacaactagccaatcgggggcttaccacggaaatactacagattaacgttgacagcaagcttgtctttcagagcctagaaaagcggtatgctaaacattatcaagctgccgtcgaccggattctagcacttgaggcgccctattcaatggtcatccaccaatggattccagagcggcagaatcagggggcgcaccatctggcccaacagggattaccccatttaactgactgttgataggcttaactagcgctttgagcgtgattttagtaaaataataagtaacgctagaattttggaggagtacgatatggttttagttacagaaataatgtcattcatcatcttcattaatgccttattggcaattattacaattttgagacagccccgcgatattgcggccacctgggcgtggctgctagtcttaattttactacccgtgggcggttttatcctatatatgtttaccggacggggcttatcgcggaaaaagattttccaaagtcaatcgcaaatcgatgatgggctttccgcattggtcgacattcaacgtaaggaaaatcgtaaaaacgacctcttaccgaaaaagatgctttccagtgaagcatccgaaatggtgaatctctttttaaatattaataatgcgcccgttttaaagaataaccatgtcaaaatctatactgacgggcaagcaaagtttgacgccctttttgtcgacatcaaacaagctcaaaaaagtattcatatcgaatattatacgatctataatgaccgattgggcaatgagttacaacaactattgattcaaaaagccaaagaaggcgtttcagtcaacgttgtctacgatgcttggggctcccaaggcgcaacgcaaaaatggtggcgtgcacttgaagatgtcggtggccacgcgcgaacgttcttcagttcaaaacacacaattaccgattttcgcttgaacttccgtgatcaccgtaagattgtggtaattgacggtaagattggttatattggtggctttaacgttggtgatcaatatctaggccggagtaagaaattcggacattggcgtgatacccatatgcggattaccggcaatgccgtattagccttacaagtacgctttatgatggactggaacgcgagtgttgagcctgcgattaagttaacttactcggaagaactcttcccagtggaccaatcccaaaatcgtggatcagcagccatacaaattgtctcaagtggtcccgataaattagatgaacaaatcaaactcggttatctgaagatgattagtaccgctaagaagcgtttatggattcaaacgccctatctagttccggatgatagtattattgatgcgttgacgactgcggcaatgtccggggtggatgttcgtatcatgacgcctaacatgccggatcaccccttcatctaccgtgcaacggaatactacagtcaactcttgcatgcagctggcgttaagatttaccggtatgaagatggattcttacatgctaagacggcggtcatggatgggcatatcagcactgtaggttctgccaatatggatatccgtagtttcaagctgaactttgaagccaatacgtttatttacgatccgaaagttgcagcgcaacttgaagcgatctatcaggctgatatggaaaaagcatccctactaacagacgaaataatcgcccaacagtcaacttggttgaaatttaaacaaaaattttcacggttactttcaccaattttataaaatgttcgttaactcatttttatgatggtgcaatattaaattaatcccaatctaaaaaattttttaaaatctgttaagctttgtccggcgtgcttttgaaaaattttgcgcattagcagggattgactttacccataaatatgtttaacttaagtacaggacgttgcccaagacaatcaaatgaacattcgtaaacgaccactataattagtggtcgttttttgttttatctacaatatgtggtgtttattgattgcatcttccatttcaaaacggtatactatttttatcgataagagaaatacaagggagttaacgattatggcaaatatcacattatatactaagaacggctgcccacaatgccggatgacgaaacactttttagaaacgcacaacgttccttttgttgaacataacatcaatgacgaaccacaatatattgattacttgaaggaacaaggtttccaagccgttcccgttttagaagcggatggcctagaaagcttctcaggttttagaccagcggaattgcaaaaattggcgatttaagcaccatgcattcccagttttaacgggtgaggccgactcttgattactaaagagttggtcttcactttttttaaaccctaaaacagctaatatgactagaaagtggtggcaaggatgtctttaaaagagattaaaaccgaagatgtaacatactatgaattgaataaccaaattaatattccagtgaatggtcaaattccattacaaaaggatcaagaagcactcgatgcctttttggaacaaaacgtacaacccaatatggtgacgtttaaatcacttcaagatcgtctagattatttagtcgcggaaaattattatgaagcagattttttgaaggcttattctctttcattcatggaagaattgaatcaatatttaaaggaccaagacttccacttcaagtcatttatggctgcttataagttctatgcgcaatacgcattaaaaacaaacgacaatggcttttatcttgaagattttaaagatcgcgtttttgtgaatgctctctacttcgcagatggtgatcaaacccttgcgctgcaactagcggatgaaatgatccaccaacgttatcaaccggcaacaccatcgtttttgaatgctgggcgttcacggcgtggtgaattagtttcatgtttcttactccaaacaaccgatgatatgaattcaattggtcggacgattaactcggcacttgaattatcacggattggtggcggggttgggattagcttgtcgaacctccgtggagctggcgatccaatcaaaggcatcgacggtgcagcaagtggtgtcctccctgtcatgaagttattggaggattctttctcatactcaaaccaattaggtcaacggcaaggcgccggcgtggtttacttaaatgccttccatccagatgtgattgctttcttaggtgctaaaaaagaaaatgcagacgaaaaatatcgtttaaagaccctttcattaggcttagtcgtccccgacaagttctatgaattggtgaaagctgatgctgatatgtatttattcagcccttacggtgttgaaaaagaatacggcgtacctttctcatatgttgacatcaccaaagaatatgacaacttaatcgccaacgacaacatcaagaaaaccaaaattaaagcccgtgatttagaaaatgaaattagtaaattgcaacaagaatcaggttatccttacatcgtcaatgtggacacagccaatgctgcgaacccaattgatgggaagatcatcatgagtaacctctgttctgaagtcctccaagtgcaaaccccgtcacaaattaataaccgccaagaatatgacgtgttagggacggatatcagttgtaacctgggttcaacgaatattccgaacatgatgacgtcacctgactttggtggttctatcgaagccatggtgcgtgctttaacctatgtcacagatcattctgatattgatgtggttccttctgtggctcatgggaacgaattggcccacaccattggtttaggtggcatgggtctgcataccttctttgccaagaaccacatgatgtatgggtcagaagaatcaatcgactttaccagcaattatttcatgcttttaaactactggacacttgttgcttcaaataagattgctaaggaacgtcagatgacctttgccaactttgaaaagagtaagtatgctgatggtagttacttcgatcaatacctcactgaagactgggcccctaagacggacaaagtcaaagcgattttcaaggacattatgattcccacaaaagccgattgggaagctttaaaagtagccatcatgcaagacggtttataccatcaaaaccgcttagccgttgcaccaaacggttcaatttcatacatcaacgatacttctgccagcttacaaccgattgttaaccggattgaagaccggcaagaaaagaaaattgggacaatctattaccctgccccaggtctttcaaacgacactatgccctattatgaatcagcttatgacattgacatgcgtaaagttatcgacatctacgcagcagcacaaaaacatgtcgaccaagggatgagtatgacgctcttcatgcgttcaacgattccagcaggcctttacgaatggaaaaacggccggactgacaaaatgaccacccgggacttaaacatcttaagaaactacgctcaccacaaagggattaaatcaatctactacatccggacctacacagacgacgaaagtgaagtcggcgcaaacgcatgcgaaagttgtgtaatctagagtgcgtttgaaacggtttgactttgagcattagtctaactcggcgaataactgctataagcagttgtttgacgagtgtaactaagcgcagaagtcagtttcaaaaagcacgtttcaaaacagagtgcgacggcaggcgtttatattttgagcattagcatagggaagcgaattagcgaagtagtcgatgatttgattcactgggctaagcgcagaaagttagcttgaaaagcacgtttcaaagcaagcaccaaatctccaccccagctgctcgtcagctggtctacatacctaaaaaagaagcacgttaaaaggagttcatgaacatggcagaaaattatattgcaattaactggaaccaagttgaagatcaaattgataaagcaacttgggaaaaattaaccgaacaattttggttagatacgcggattcccctttccaatgacttagatgactggcgcagtttaccagacaatgaaaaatggatcgtcgggcatgtctttggcggcttaaccctacttgatacgctgcaatcacaagatgggatggccagcttaaaagccaatatccgcacccaacatgaagaagccgttttaaacaacattcaattcatggaatccgtgcatgcgaagagttattcatccattttttcaacattaaacacaccaactgaaattgatgaaatcttcgactggaccaacacgaatgaattcttgcaatacaaagccaacaagattaatgatatctatcaaaacggtacacccttgcaacaaaaaatcgccagcgtctttttagaaaccttcctcttctattctggtttctataccccactctattacttagggaataataagttggccaacgttgctgaaatcattaaattgattatccgtgatgaatcggtccatgggacttacattggctataagttccaattagccttcaatgaattggataagtcagaacaagaagaattgcaaaactggatgtatgatttactgtacgacttatatgccaacgaagaaaaatacacccacgaagtttatgatggcactggttggacagaagaagtattaacttacctccgttataacgccaacaaagccttaatgaacctcggtcaaggcgccctcttcccagatagcgctgaagatgtgaaccccgtgatcttgaatgggatgtcgacttcaactgccaaccacgatttcttctcccaagttgggaatggttatcgcttagggaatgtggaagcgatggaagatagtgattacgactttgattaattaaatgcaatagcgcgccccactaatttaagtgagacgcgctatttttttggttattttttaaattgtttcagatatcgtccggccaataatttatgaaacttaacgcccaacgtcggatttgatgcatcaatatcggcatacatcgccgttgtaatcttgttgagtagtggcactaactggtcgagttctgcttcggtcaaggcgttcacaaacggcggcacctcttgattggcagtttcaatttcttggcggccggcatccgttaagttaactaaattaacccggcgatcacttgggagcttacttaacgtcaccagctcgcgtttagcgagtttagcgacaaattcactggttgattgaggtgacattcccaaacgcgttgctagttcacgttgcgataagtgatcttcatcagcaagtgccaatagaatcttcccctggccttcgacgattaaatgcgggcgtgcttgtttaacgatatcatcgtagatcttactgagttgttcatattcagctaattttccggcgaccaactcggccttgacactctttgccatacgtcatcttcccttcgctgttttaattagtatacaccattccaaaatctaagagtagcaatccttgacattttaatcaggaacccttactatataaattaatcaggggacctgattattaaacaaggaggcaatattatgtgcagtgagcatgtcattgaagtgaacaatattcaaaaagcatttgcgaccaaaaaagtggtgcgttccgtttcgctagccgtttctaaaggtgaaattttcgcattattagggcccaatgttgccgggaaaacaacgctcttaaaaatgatgaccaccctcctacgaccagatagtggcacaatcacattaaatggctttgatacgataacacaaagccgccaagtgcgccaacagtttagtgtcaccaatcaaacagcggcaatcgatcaagacttaagtgcgcgcgagaatctccgcttatttgggcggttaaatggactcagcgccaaagcgagccgaacccgagctaacgagttactgacggactttgacttgaaccaatcagcggatcaaacattggcgactttttcaggtgggatgcggcgacggttggacttagcggtcagcttagttggcaagccaaggatgctctttctcgatgaacccaccactggtctggatccaagaacccggacgcagatgtggcacgcgattcaaaaattagtcgcggatggctcgacagtctttttgacaacacagtacttagaggaagtcgatcaatatgcggatcagattgcgctgattgatcatggccaattgattgccagtgggacacctagtgagctgaaagcgcaagtcggtggtcagcagttgcagctgacgattgccaatcaacaacaagttacccaggctcagacgatttgcgagaccgttttgcaacagcccgtgcgtgtgacggatcaaacaatcattgggccgttagtgcacgatgatatgggcgtcatcaccgcgattttaaatcaatgtcagctggcaggcatcaccatcagcgatttacaattgacagccccatcgttagatgacgtctttttgaaaatgaccgttggtaaaaactaaggagataataacatgctacaaatgaaaacaaatacgcaagtgttgcgcaatagcttaacgttaacccatcggaatttactgaaaactttgcataatcctgataatgtcggtgatgttactagtgcagccaattattttcacgctgttatttggctatttattcggtggtgtcattgccggcagcgtccacgcctatttaccgatgttggtttctgggattttagtgcagagtattttaaacgctgcttcgggttccggtcaacaattacgagaagatattaatcagggaatcttcggccgttttaagaccctaccaattgcgccaatcgccccgcttgccggtcaattagttggcgatagcttacgattactactttctggtgggatggcaatggttaccgcggcattaatgggctggcgccccaccgttaattttggcgcactcatgatggcgttgttcctagccgtctttattggctggtcaacgtcgtggattttcgccttagccggtttactggttaaaaatgccgaactgatcagtagtttatcgatgattatcattctggtattgaccttcttatcgaatgcttttatcccagttaaaacctcaccgcattttctacaaaccattgtccgcattaatcctgtcaccacaaccattacggcaatcagaggaattttgaacaccggtcattggagcggaaccgcaacaatggtcctcgtcagtggcactgtgattattctggtgtttatgccactgacggtcatggcgtatcaacggcgtgactagaataaaatagcgcgccgcacttgtaagatagtgagacgcgctattttagtttaaattacttggtagtcgatttgatcaatcttgattttgggtaattcatcaatattcttgtctgtaatgatagcgaaagagacatacgcgcgatcattttcaggaagctcttcgtaagtgatcgtgccgtacgcgagtttaaacagcttagcatgcttacctacttgatctttagcgactgcaaacacatttggctggccaaaatacgtatttgtagtttgttctttgccaccttcaagatagtgtttcatagcagtggcatccttgatgaaccctttttcagagtttagcactaaataatcgttaccgacgcgataaatataaccagagactttcttttgattcgaatgagtcgcagttgttaatctgattgttccgtgtttaggtaaactagtccctttttttagtctgtgttttgggtggcgtatgtgtttcaatggaacgattgcaaccagtcataaaaagcattgtgatagatagtaataaaatgaagactggcattatttttttcatagtgattgttttctcctgctgaggcctttttttgataacgttttaaatgataactacttgtagacggcgagtggtttttccgatagagttaatacttatagtttagttgaggagtaggatgaattaatgcggaacaaaatgacaatgagcgacaaattattatatggcgggctactggcagctgcggggggctttgattcttacacttatttggtgcacggggaagtcttcgccggattacaaacggggaatctaattttattaggaacccatttggggcagatgaaatggtccgtattattacggcacattaccccgattctcgcctttatgttgggaacaatcttaacgcgcattttacaacatcggtttgaaaaagacgaatcgattaacaaacgacaacggattatcttggggattgaagtcttggtcttaacgattgttgcgggaatttcaccgtatgtaccggatattgttgcaagttcacttgtttcaatcattgcggctgcgcaattacaggaatttcgtgaattggatggtggcccatttacatcattgatgatgactggaaatgtacggacgatggcggaaagtttttatgacgctgtttttaaacatgatcgtaaggcagccgataagtgctggcaaattttacgcatcattatcagttttacgattggtgcagtgatggtcggactatgtgtctcattcttaggagaacgaacgttgattttatcagcattattcttgttgatgacgatgctgattttacaattaaatccagacaagaaagtttagcctagatatgttacgctggaaggtaacttgccaaggaggttaatagatgttctttttaaaaggaatcttgatgggatttgcgtttgtcgcaccaatcgggatgcaaaatattttcgtttttaataatgccatgtcgaatacaacacggcgggcagttttcaacagtttgttcatctggttatttgatgcgctcttttcactcgtggcgttttatgggattggcgcactgattgtgcaaaacgatgcggttcggttagccattatgggaatcggtggacttttgattttatggattggatacaccattttaaaaagtgcccgcagtaccgttacgtttggcgcgttagaaccaatgccactggggaaggttattttgactgcatttgtggcggtttggggtaatccgcaagccttgattgatgggacattaatgctgggtgcattgcggggtggcatgacgagtagcgaggcgattccattcatcgtgggggttgtttcggcaaccgcgacctggttctttggtatcgccattatctttagccttttccggaaaaaagtttcaccaaaattcttgatgggcgtcaacttagtgagtgccatcatcatcatcgtgtatgggcttggtttattggtcaaagtggggacaacattgctctaggaagggatattgctttttaatttaccctgttgaatggtatccttaagtatcaaaacaaagcgaggtagaacaggatgcgcaaaacaacaatcattgttagtttagtaacgctcggcctattgacgggttgtacagccaaccaaacaaaacattcagcaccccccgctcaaaaagaatcgactagtccgcaacaaacggttcaagctccgaaagtgacgcttgaaaaagcccgtgaattgtacgcaaaacaatatcctgcatcagatttaaccgaggttgagctgaagcaatggggtaaccaaatgttttatgaattaacgggaatgaacgacaatgaagagcttcacatgcatgtggatgctcgaactggcgcaaccagtcgattgtcgaaagaagcccttgatgccgatgaacaaaatgacgtcgagcgacaccaaaagcaattagcgtttgaccaattgttgacgcctcaacaagctcttcaaaaagcgcaacaatactccaccgggaacgtgatcaaatggtcattggaaaaagatgatggccgaacagtctgggaagtagaaggtcatcaaaaacagcaaaaaatgcaagttaaattagacgctgaaactggcgcgctaattgaaaaagaaatggatgattaaagcagtatgtaaagcgccgtcgagaataatttcgacggcgctttttttgtagcttgcattaataaatttgttgccgatttaaataaaataaattagcattgcctaattttttatttacatttcattaaaacggcgtacaataaaactgttatcaagattaaaataaggagtgaggataatgaatcaacaagaaaagggcaagaagcacaagctgattgaatatgcgaacggccaatcacttgaagaaattaatgggacggtcgaagtaccagagggcaaaggcttttggaagatgttactagcatattcaggtccgggtgcattggtggcagtggggtatatggatccagggaattggtcaacatcgattactggtggtcagagttttcaatacctgttaatgtccgtgattttggtgtctagtttaatcgcgatgttattacaatatatggcggctaaactaggcattgtaactcagatggatttagcacaggcaattcgcgcacggacgagtaaaccgttgggcattgtcttgtggattttgacagaattagcgattatggcaaccgatattgccgaagttattggggcggcaattgctttgtacttattatttaagattccactgctgattgcagtattcattacaattttagatgtcatgctattattactcttaacgaaaattggttttcgtaagattgaagcaatcgttgtcgcattaattgtcgtgatttttgtggtttttgcttatgaagtagcactttcagatcctgattgggcaggggtgattgtggggctagtaccaactgctaagacctttgccaccgggccagctgttggtggattaaccccattgactggtgcgctagggattatcggggcaactgttatgccgcataatctatatttacactctgcgatttcacaaacacggaagattgatcgcaagaacgaagcacaggttgcacaaacagtgcgctttgccacttgggattcaaatattcaactcacgatggcatttttcgttaatgcgttgttattaatcatgggggttgcagtttttaaaacgggaacggttaaagatccatcattcttcgggttatttgaagctttgtcagatacctcaacaatgagtaacggaattcttgcaagtgttgcccggaccggaattttatcaactttgtttgccgttgcattgctcgcttctgggcaaaattcaacgattaccgggacgttaactggccaagtcatcatggaagggttcattcacttgagaatgccattgtggttgcggcgtttggtaacccgcttgttatcggtgattccggtattaatttgcgtcatgatgaccagcaataaaccagccttggaagagcatgaggcgatcaataccttgatgaataactcccaagttttcttagcatttgccttaccattttcaatgatgccactgttgatgtttaccgacagccgggttgaaatgggggatcgcttcaagaatagttggttgattaaaagcttaggttggttatcggtcgttggcttgacctacttgaatatgatggggttgccaggacaaatcgaagctttctatggtgatcacgcaagtgctgcacaattggctactgctgatcacattgcatatgtgttgattgctggtgtgatggcattattggtttggatgattattgaattgtataaaggcaataagcggtttgaacagcaattagcaactgaaaattaattggaggttggtcacatgtcagttttagaaattaaacgaattttagtcggggtcgatgactcagaggatgcgttattagcgtttgattatgcgattgagcgggctaaacgcgaggatttagaattagtcattgtatcggtattggaaaatgatgaaatgaacgtctatcaagcattgaacaaggattttatccacggtcaatatgagaatcttgaaaaccacctacgggaatatcaagatcaagcctatgtgcgcggtgtgaattatgtgcgaacagtaatcgcagaaggcgagccaggcgaagcgattatcgaagatgtgattcctaaggttaaacccgatttgttaattgtcggttcgaaatcacaaaagggcgtggttaaatacttcggcagccaagccgcctacatggcaaaatacgcaccaatcccggtgctggtagtgagataaagagtgcaaaaatcgccggagatattgtgaggattagcctaacaacggaagaatatggcgattgcagcacgtttaaaaaagcgtgtgttcggtcgcggatagcaactgagtattttagattaagcggaggttggtgcaaccaaaaagcacgtttcaaaaagatgtcgataatttattttgtcggcatcttttttatatgctaagctgagaaaataaaagtttaagcggaggatagattgtggataatgaagtcgcagctttttgggatgattttgcagcggaatactatcagattcaacaagagtcacaggtgtcgattgtcactgacgttgtggcttttttacaggatcggcgattactgtctgttgagacagtggctgacttaggtggtggtagcggccgttatttgccacctctagtgcaaaacagtcaggcttatacgattatcgacatctcggcgcaaatgctccagtatgcacaacaagaagctaaacagcatgtaccagaccaacagattgcttatcaacagcagtctgtggctgactttatggcgcaaacgccacaaaaaagctatgatttaatttggatggcgttaaatccggcaatcgaagccaatcaagcattactgacgattagcgaaaagagccgtcagtggtgtgcattcttacggctcactaaaaacgaggacgacttgttcacaccgcttgaacgttattttgggattgaacagcaagatcccaacactacaccggaaatcatcccagctgtggaaaacgtgttaaaagatgcgggctaccaagttagtcaacaaatttttcaatatcaaacaagtgaagttttcgacaggccatttttggaggcctattacgaagaattaccaacggaccaactggcagcttatctagatcaagtatttgcaactcaaaaaacacggaccagtacaacaacgcttgaatatacgttgctgtattggcacgtgttttaagagttaaattcccaccgccaccagtcctgtcggaatattttcaactggtactgggtagaatggcaggccggtttggatggccgcaatcatcatgtgattaagatccatgatttgatcggcgctgattgttgctgatggtgcaagtgcagttgggataatgagtgctgttagttggcgattgttaatgcgtgaaagaataatctcaggatcaccaaggtttgaatcgccgtgatacgcactagcggcccgttctgctaatccgagcgctttttgtcggagttcatgacgcgcatttgtgagtaacttgtcgagtaagtcgtcatctgaaagagaatcaggggaagtttggatggcttgatccatccggtagtttggattaacgacgagttccttgaagagatttaagttgccgggtaatgtgaccacgtaaatcggtgctttttcaggcagcaagtcatcaagatagcggccaatcacgcggaaatagttagtttgatcgataagttgttcattttcttttacaacaaaactgtgggttggacttgagaagccttggacgacttcgcctttacgctctgtgccaatcccaatttcaatggttgttggggcgtctttaggtaaaggataatcccgaatgacattttgttgaatggatttcaaactaaaagtagtcttgttgagacagagaatggtcccgttcagactcagacttaattccgaactgagtggacgcaggtcgggttgatcagcaattagaaaatattcagtcgtgatcggataatgaaggggttggctgtagtgaccagcagctgtgatgtaaaacgcaactgactgtatatgtgctaattcttggggagcggtacttagtaagtcctcaagttggttgagtaaggctttttcttcaggatagtcggtggttaactgttcacggatttgcttagaaaaactattgagcttaatcttgttcgcattaatggcttgtccgccagtctctaagttaatgaataacgagatgactggctgatttgaatcggcgagtaattgagttaaactttctggatataacatatcgacacctccgtttgattaacttcaccttatcatattgaacagctacctttcaagaaagatgcctttgtaaaaaataagccaacgagggacttttaatcaacttgatggaaacggtatgctaaaatggtaagtaggttaacaagggaggatttatggtatgggagataagacgaaagtggtaacacccacgaagattagcaaaagtattcggacccgtttttttgtactacaaatggttgtgattctaatccttggcgcgctcacaattaaacttgtgagcggctttagtccattattgacggattcagaaattctaaaaaatacaattttgacagcttttggggcaaccttagtcgcgcttgtagtgtggtacctatcgtataagattattgcaatgcgcattcggcgccaaatcatgaataaagagctagaggatagctacacttttagtttgaatcatgctgctagcagtcttagcttacatattgtgtactttatcagtatgttggtgattgtctggttgatgttgagtgctcaaaacgtgcgccagtcgctagatggcttacaccttttcaaaggtgatcaaccgattgtccggctggtcgataatcacagcatgaagcaaatcgagcaattctatcaagctgataagcaacaaaagatgacgtatcttggcagcaatcgagatgttgcttatttcaagattaataatgcaacgattagcttaccattagccaagattcaattctatggtcaagatgaagcgccgactggccatcagaaacaagtgattcaacattatcacttaaaagatgtgcaaaataagaaatacctcaaacctaatatttatattagtgaatcaggcttacctaaggtggccattacgaagatgtaccaacattatgagccacaaccagcggataagattcataaactcgacattaaataggataactaccacaggagggctggattaaacggctttcatttggtacagttagagatatgaatatttttttaaataaaggagatcaagtcatgattgaagcagtaaacctcagagcaggaatgacgtttgaacaagacggcaagttaatcaaagttttagaagctaaccatcataaaccgggtaagggaaacacggttatgcgtgttaagttgcgtgacttacggactggctcaattgttgaaacaacaatgcgcccagaagttaaagttgaacaagcaatgattgatacaaaagatgttcaatacttatacacacaagataacgtggcattcttcatggatcttgaaacttacgaacaatatgaaattcaaacagctgctattgaagctgaattaaaatacttattagaaaacatgaactgcaagattcaattcttcggttcagaagtgatcggggttactttaccaactactgttaacttacgggtcgttgaaacacaaccttcgattaaaggcgcaacagtgactggttcaggtaaacctgcaacgatggaaactggtttagtcgttagtgtccctgatttcatcagcgctgacgaagtccttgaaatcaacacacaagaaggcacatacgttaaacgagcagcaaaataacaagcttaaggccgactagtcccatagtcggtacttcaaagtgaagccaagatggttttctttcgataaaagaaggaatcaccttggctttttatgtttgggtaaagggacaaaaaaataacagagaagcaacttatgatggattgcttttctgttagttatcaaaaattatttgacgcaaatcgtggctttaacaaacaattctagtgaatataaacagttattacggtaacgagtccgaaaataacgccagggatgttagaaataataaccggccaatctttataggttttattccagccataggcggtccatagacacccattaattgttgcgactaagggctgtaaaggtgagacaggtgaccctgaaaaattagcgataatttgggggatgtatgaaacatacatcgtaatacaggtgattgttgcaaccttgctaagtaattttaaacgtttaactttcttagggtggacggcgttttcgccggtagggtattcgccagtatcaatgcgcataatagactccgtttcatgattgaattttattatatatggttgacttgaaaccgcttaaattctatagtgatagtatgcacgaagtgaaagagagtggaggttttacgaatggcaaagaaaataattcttgattgtgatccaggccatgatgatgctgttgcaatgatgttagcatacggcaatccagaaatcgatttgttggcagtgacaacggtggctgccaatcagacgttaacgaaagtgacgcgcaatgccctcgcagttgcgaccatgatcggcatgcacgatgtaccgattgctgctgggtgttcgcgaccattaattgaagaaattaaagtagcagctgatatccatggggagactggccttgacggggttgttcttccagaaccaacggtggcgcttgaaaaaagtcatgcagttgatttaatcattgatttaattatgacgcatccagctaatacaattacattagtgccaacaggtgcgttgaccaacatcgcaatggcggtacgcaaagaacctaagattgttgaacgcgttaaagaagtcgttctaatgggtggcggttatcacgaagcgaatgcgagtgcagtggccgaatttaacattaaatttgatccagaagcggccaagattgtattcaatgccggctgggatgtcacaatggttggtttggatttgacgcatcaagcgttagcgacaccagatattgttgaacaaattgaaggcattcatactgaaacgtctcagttcgtgattgatttgttagcctttttccgcgatatgtacaagaaggggcaaaatttcgatgcaccgcccgttcatgatccatgtgccgtggcttacgtgattgatccaagtgtgatgaccactaagaaagtgcccgttgatatcgaactcaatggaacattgacgcgtgggatgacggtcgccgattttagattcccaattccaacagactgtcacacatcagtcgctgtaaaacttgatcatcagaagttctggggattagtggaagacgcaattaagacgatcggctaaatagtcaaaatacttgagtagagaaggcgttgtacatgtatcacgcattagaaacccgttatcaagggatgcaatataaccgcgtcggacattctgggttgaaattaccagcgatttcattagggttatggcataactttggtgaaaccgataagatggcgactcaaaaggaaacgatttttggcgcgttcgatatgggcatcactcatttcgatttggcgaataattaggggccaccagcgggcagcgccgaggaaaactttgggcggattttacatgataatctgcgtcgctatcgtgatgaaatgattatttcatcgaaggctggctattatatgtggcccggtccctatggtgagtggggctctaagaagaatattatcgctagctgtgatcagtcactaaaacgacttcagtcagattacgtcgatattttctatcatcaccgaccagatccagatacgccgattgaagaaacagctcgggccctagatttattggtgcaacaaggaaaggcgctatatattgggatttcgaattattcggcagaacaaaccaaagcgattacgaaggttttcagagcgctcgggacaccctttattattcatcaaccacgttataacatgctcgatcgatggattgaagatggactaacggatgtcttggcggatgaaggtatcggtgcaattacgtttagtccgttggcacagggattattgaccaatcgttatttaaacgggattccagccgattcgcgggcagctcgtccagatagtcccttcctatcacctgaaaaggttgatcaaacaatcagtacggttcaagaattgaacaaaattgcgcaacaacgtgggcaatcattggctgaaatggcgcttgcgtggaatttacaacagccgactgtagccagtgtgttagttggtgcttcgcgcttgagtcaattacaagacagtgtgcatgcactagataacttaacgtttacggccgaagaattagcggctattcaaaaaatattagcataattaaaacgacgactagctacgtaagctagtcgtcgttttttttgtttttattcagctgtttcagttgcggctgcgtttgcttggattttaccaagaatggcgcgtgagaaaggtcccacgatgatcagttgtaatggtaatgcgacgatgacattcatcaaccatgtgtgacgatagacactacctaagtggtcagggataccaccttcgatgagaattccgaaaagtgacatacatgtgaccatgccgagaatcattaaacatgaaattgtgagaatcatgactaatttattttctttgttcaatggtaagctaaatgcgatttttttagcaattgcaccgacaacgaatacatctagaataaatgcgacgatgaaacctggaattaaaccggtaaacaaagcaccccatgatagactatcatgtaaaactaagttatagatactcattccaagtaccatgcagaaacacattaatgttgtaaaaataataccttcttttttattggttggcattttaaattccttctttctgaaaagttaacagatataaccgtatcacataaaaaatttcggcgtaagcttttttttcagaaaatgagaagtttcttctttttaaatttcaatgggaatctcgccatcatgaacggcgtgaaaaatcgaaacgagcaataatgcgcagacaaaaatcaatgggaacccagcaatcacgcaaacggcttgaatggtttggaaactaccgacaagtacaattccaagtgaaaatagaatgaaaatgatcacccaagccatccgattccaacgattaggttgttctccgattttcaattcaagactggtaaatgatgagacgatgaaggccgaagaagagatcgttgtcgccaggaaaatgaaacatgacagacagaaaattgctaacatgataattttgaacggtaaggtcgtgatgaccgccgcgatgacagcggcttgtccttgggtattcaatagatgaacaagatcgatttgaccggaacgttgtaagaagagcgcataaccgccaagtacagcgtaaaagctcatacaactaaatgcgccgtatgtcgccattcccaataaaacttggcgaatggttcggccgcgtgaaatccgagcgatgaataagcccatgacaggcatgtaagataaccaccatccccagtaaaagagggtttcgtgttgtgcgaacgcactgtgtgcaccagtctgatttaaacttaaacgcccgaagttaccaaagagatggaagacatcgcggccttcagcgccaattagcttgaatgtcggaccgattagtaagacgagtaataaaaagccaatggcagtatagatatgccaagcactgagcttcttaatgcctttatctaagccggcatataccgtgagggtgaatagcaccagtaagataatgaagagggcaagtttaagccagatggtatcattcaaaccggtcattgtgctcaagacttttgaaatcacgggaatttccattccgattgatgagccgatgccccccataatgccgaaaacaacggtaaagtcgattaatttgcgaattatttttttgtaaggttgtggtccttctaataggtcgattgcggcgcttaaacgttgcacccgtaagttcttaacatagagagcgtagccaattgcgacagtcgcggtggcaaaaatcatccatgccatgggtccccagtgaaattgcccacagacgttggcgtagcggtatgcttcagccgagaaaggtttagcgccaaatggtgggttctgtaagtattgcagtggatcagtggtactaagcattaagatgctagcgtcaatcccagttgcaaaaaccatactcccccattggaagtcgttatattctggcttttcatttggttggccgaggcggatatggccatagtgactacaccccaaccaaaataggaaaataaaattaatgatataaataccaatgtaaagccatttagaatgtgccgtcatcacatcaagtagttgtgaaatcgactgctgaagcgtgtcaccccccaacattaaaaatgcggagacaatcccgaacagtaacatcgtggggatgaagacgactttatcaacattcttgcgctttaaaataatattcctcctgaatttgttaaagtctaggttgctggatcaaacaaaaaaagcgcccatacaattggtcaactgaccacctgtacaagcgcgttattataacgtatacaaatgaagaaacagcctaacttgatttacttcttactaataggatagcacttatctcaaatttgttaagggtcgattttacggccgtgcggttgttaaccaattaagatagtcttgttcgcggttaatcgcgtgttctaaaataagataatgaccatagtgcgcatccaccgcagcttgttggctgaaaagggtttgacgtcggtcgagtaggtgatctagtttggcttggtgtaaggttttttgttcggtgaacattgcgtctaaatgagcatctttttttgagtcgataaagtatagcttcaaaataaattcgtctttgctggcaataatttcgctggttgaggagtatcgccactcgtcaaaaaaggcaatcccatctgcagtgattgaatactgcttcttttttaattttgttccggcgatcaattcgacgtgggtgatccgatcagcctgttcaagtcgcttgagttcaggatagatttggctgtgttgggcctgccagaactcaccgatatcatcttcaaagacgcgttttaaatcataaccggttttgggagactgatttaacagcccgagaattaagtattggagaatgtttttttgggccatctgaaagtgcccctttctgtgaaatcaacttagattaagtatagcacaggccagtgttgaaaaatggttactttttataagtatttttagttgcatttcataaatagttagcgtaggctatttcaatcgggtaaaagtgcgttcaagattgaaaagcacgttaaagaaaatgagtgcgtcaaaagtagttatcctgtgaggattagcctaattagccaaatgagcggcgtaaccgattggttggctaatgtagctaaccggaacaggatgcttttgaaagcacgttaaaaaggagtttcatcaatggcaaaaaaatcaaaagtggcaaaattagcaaaacaacgcgcattagtagcgaaatacgctgacttgcgcgcagaattaaaagcaaagggcgattacttagccctctctcaattacccaaggattctagcccagtgcgattgcggaaccgcgatgcaatcgatggtcgaccaagaagtttcatgcgtcaatttggtatgagccgcatcaacttccgcgaattagcccataaaggccaaatcccaggcgtcaaaaaagcaagctggtaaaaaatgagtgctgaaaaagccggttaacttacgaggattagtaaaattagccgaataaccagcagagctggttgtttggctaatagtgctaaacgcagtaagttggctttggaagcacgttcaagaaaagtacgttcaaaaaaaggagcactgactgataagtcggtgctcctttttgcgttagtctgcttttatgatggtttcaattagatcaaaaaatccagctgcatcaacgtcgtagacgagtttagccggacgtccgtttttagttaagaacgtgcgcccgccggcaattccgtttggaatgacatcacagacaatggcttttgttttaacgattgttggatcaagaaggtaacaagttgttaaaacgtcccataaataataagttgaattagttttgaaatggaccagttgaggaacaaaggcgtaacaggtgccgataaagtccatcatggcattggcacgtttgctagcccaacgttggcgaatcgccggcgttaagggaacattattcgtactttcgagcccgactaattcaatagggatttgtgtatcgaagacagttttcactgcttcgggatcccagaaggcattccattcagcagtaccatcagaatcgggttcagcaacgttgccttgttcaagaaaagaaccgcccatccaaagaagtttagcgattttatattcgatgcttggattgatggcgagtgcgcgtgccaagtcagttaatgggccggtaaagagcaatgtgacgggttcggttgcttgattgagtttagtgattagatcgagatgtgcggcttcaggactcagaggcgtttgaatggtgccacgttcattgagcacgggaagtgcatcgactgagtaagcgtcagttcgccattcttttggaaaaggatggactgcgcgtgagtcagaagcggccacagctaaccgcgctgattgatctgaaaacgtatcaatgattttacgactcgcgctaacggctggttcgacatatgaatcagcgccaattacgccgacgccaagtagtttgattgtcggcatttgtaggagcagagttaatgaaatcaaatcatcaacaccgccatcgtgattaaaatagacttgtgtttgcatggttcgcctcctgattgttcgttagttatcaattaatattagcattatctatatttcttagcaacaaatacaatataaacgaacaatattttataaaatgaaatcaatgtattgattttatgtcgataacgtgtttataataaattatcaaatttattgacggaggcttatttcatgaaaaaaagtttggtcgtacttttctcgacagtccttgtattaggtggcgtgttagccgggtgcgggagtcaaaagacagcatcaaagaaagcaacgcacacagcagctttagtcactgatggtggtgggattgatgataaatcttttaaccaatctgcctgggaaggtttggaaaaatggggtgctagtcatgatcttaaaaaaggggtcaatggttacaattacgcacaatcgagttctgatgcggactttttcccgaacattaataagttaatcaaggcaaaataccaaacgatttttgcgattggctataagttagataacgcggtcagccaatctgcaaagaataatccaaatgttaactttgcaatcatcgattcaaacgttaagaatcggaaaaacgtcgcgtccgtcaattttaaaacagaacaatcatcattcctagccggggttgccgctgcgaaaaccaccaagacgaataaagtcggctttgtcggtggaattgatagtgccgtcgtgaaaacattcgaagctggttttaaacaaggggtgaaagccgttaacccagcaatcaccgttgatgtgaaatatgctggttcatttacgaaagccgatgtcggccaatcattggcaaccgcgatgtacaacaacggcgcggatgttatttatcacgctgctggtggcactggcgctggcgtctttaccgctgctaagaacatttctaagggtggtcaaaaagtctgggtgattggtgttgatcaagatcaaaaagccgatgggaaatatgatggtggcaacgtcacattagcatctgccgttaaacaagttggcacagcagtggaagatcttgctaaccaagctaagaatgataaattccctggtggcaaaaccgtcacatatgatttgaaagacaaaggcgttgccttagtgaacgacaatgcttcccctgaaacatggcaagcagtcaaagaatatcaacaaaaaattgaagcaggcaccattaaagttgctgcagaataacgactattgaatgctaaaggatggcagcagttatcagccatcctttttgtatgcttaatgaatggagcgtaaaaatggcaaaaactgtgatagaaatgcagcacattacaaaacggttcggcgcctttaccgccaatgatgatatttcattaaccttgcaacagggtgaaatccttgccttgcttggtgaaaatggtgcggggaaatcaaccttgatgggtgttttgaccggacaattaaagccgactgcggggcaattactggtgaacggacaagcagtgaccttaaatggccctcgacatgcaaaagccctcgggattgggatggtacaccaacatttcatgttaattccggcttttacggtcttagaaaacattatcctgggtgacgaaccaactaaacagggccggattgactatgcaacggcgcggcaaaaggtcacggctttagtcgataaataccaactggcgctcgaccttgatcgaaaaatcgctgatatttcggtcgggatgcaacagcgggttgagattatcaaggcgctttaccgagaagcaacgacattgatttttgatgaaccgactgcagctttgacaccgaatgaaattcaagccttgcttgccatttttgagaagttaaaggcggaagggaagtcgttgatttttatcacgcataaactaaaggaaattaaacaagttgctgatcggtgcgtcgtgattcgtgccggacgtgtgattgatacggtactagtcgcacaaacggatccgacaaaattagcggaaatgatggttggccgtccgcaacaagcccccacaccgaaaatggctaatcaaggcgctgtgatgctatcggtggaacatgtcgctgctcgtgttgctaaacgcactgttctagatgatctgggattgaccgtgcatgcgggagaaattgttggaattgctgggattgatggcaacgggcagagtgagttaattcaggttttaaccggacaattaaaaccgcagtctggaaaaattgaattaggaggtcagtcattattgaaacggacaccacgccaaattagtgaacaaggcttagggtgcattccagaagatcgccagaatatcggtttgattttgccactgtcgattgctgaaaatttagcgctgaaggattattaccatcaaccgtatagtcatctaggctggcttaattatcgggtgatcaatcaaacggcgcagaaactgattaaacgattcgacattcggacgcaatctgaacaaacgcttgccggagaactttcaggtggcaatcagcaaaaagtggtggttgcgcgcgaaatcgccaaacaaccaaaagtcttgattgctgccaatccgacccgcggtgttgatgtaggtgcgattgaatacattcatcagagcttgattgaacaacggaaccaaggctgtgggattttacttgttagttttgaattagatgaaattttaaagttagctgaccgagtacttgtaatgcacgccggtcaaattgttggtgaagttgatccacaaaccacaacgagtcagacgctcggattattaatggccgggcaacaaccagtaggagggcgagacgaatgaataaacaacaatcttcaggattaatcattgcaatcctatccgttgcggcgggactgttagtgggcggagttgtgatgttggtttttggatattcgcctattcaaaattacagtaacctctttaatggcgcattcggcgatatctattcgattggcgagacattacgcaatgcgactccgttaattttgacagcccttggcttttcaattgcgagcaaagccggctttttcaatattggtgggtcgggtcagctattagtgggctggtttggcgcgattgtctttgcactccactttaaaaatttaccggggattctcttgattcttggcgcgattttagcggggatgctgctcggtggcttttggtcttggttggccggttttttacgggcatactttgggaccagtgaagtgatcacaaccatcatgttgaactacatcgcattgtatttcgtcaattttgcgattaaacgttggttggcgccaaaaggcagcgactcatcggccaacattgtccctaaagcaagcttgcggaccccttttttggaacagattaccaatcactcaacgtttcactggggctttttcatcgcgttagtcttggtgattgtgatgtggtggtatttgaaacggtcgaagactggatttgaaattaaggcagttggattgaacgaacaagctgcacgttacgcggggatgaatacgaaacaaacgattatgtgggcaatgctattatctggactactagctgggttagcgggggctgtcgatggtctagggaattatcaaaatatttccgtttcaaatgccttaccagatatcggctttaatggaatggcggtcgcgttattagcgaatgggcatccaatcgggattatctttgcggcgattttattctctgctttacagattggtggcttaagcatttccgtctactcaacaactccgacagaaatcgtcaatatcgtgattgcatcgattatcttcttcgtgggtgtgcgcttcttatttgaacaattactcaatcaccgcttactgaaaaaacacgcgttgatgaaagagaggcttgaaaaataatgacaatcacaatgattttaatgacgatttgtgcgaccacgttagtttacgcggcgccattgatttttacagccttgggtggtgctttttcagagcatagcggtgtgattaatgttggtttagaagggattatgattgttggggctttcagcagtgccgtctttacccttcaatttagtacggtttttggcggattgacgccgtggattgccttattggttggtggactgtttggtgcactgttctccttattacatgctttagcgaccgtaacattgcgcgctaatcacattattagtgggacggtgttaaacctattggcgcctgcattgtgtgtcttcttaacccgtgtgctgtatagcggtaaggggcaaacgccggtgattaatcaaagcatcggtaacttcacattccccggcttggcccaaattccagtgattggccccattttatttacgaagacgtcgttagtggcttacgctgcggttttggtcggcattatcagttggtatgtgctgtataaaacgcgatttgggctgcgcttgcggtcagtcggtgaaaatccagcggcagccgatacactgggcatcaatgtgagtcgttaccggtatatcggggtcatgttgtctggtttgttaggcggcattggtggcgcggtgatggcgcagtcgattacgttaaacttcagcgcagcgacgatttcaggtcagggcttcatggcattggcggcgatgatttttggtaagtggcatccaattggcgcgacaggcgcagcgattttcttcggactcgcacaaagtttgccgattatcggcggctacatcccaatactggccggtgtgaatagtgtctggttccagattgcaccatacgcgattacgattattattctggtgattttcttgggcaaggccgtcgcaccagcagcggatggcgaaaattatattaagagtcattaaaagatcagcctaagaaggcgaacacaattgcttgtgttcgcctttttaggctaatcctcagcggataaccatttgcagtcgcacgctattctaagtagtcctcttttaattgtttgatttcttctggtttgagggccattgcctttgataggtagttttcgatgttgccgtattcttgattaatcgtgtcgcggacaagttctagattagcctgtgtaatgctcttagcgttcattgaagcgacctggctatcgttacttgaaattcgggttggggttgctgagctgagtcctaggacctcatttgagaggacatagtcggcaacgattgtttcccagtcgacgccgagagcacttagaattaaaaaagttgcgacaccggtgcgatctttaccggctgagcaatggtaaaggactgcaccgtttgtatcgtgattatttaatagtacggtaaataaatcgcgataagctgcttgagcatgggagtcggtgatcaattgttggtacatccgatccatacttgatcgttcgggagtagcagcttcttttttactaaaaagccgcattaggccttttttggctggctttttaggggtatcggcttggtcagtgaatggaaataccgaaagacgatggtaggttagttggttgtcatcaaatgggtcgggggcgaccttgatttcatgacgtgaacggaaatcgacatcgtaagcaacaccgtaatttaagagatcctcaatatcagttgcggttagcgcgttcaaactacctgaacgtaataatttgtgccatttaacggacttgccatcaaccgtttggtaaccgcctaattcgcgtaggttataacttcgtgttaaatctagaacccgttgttgttcttgcataccaatccatcctttataatcagttatttctattgtataacgaagctgggtggtgtgcacccttattttaaatgttcgtgattcattcgtacacgatattgatgaaaatgaattttcaataagagtttattgacgtttgcagaaaaatctgctaatattttatcaaattttaaactggttatcgattaaagataatacgaacaatcgatgggtcggcggttaatttagttcacaaattggaggaagattatgtctgcatgggaatcaaagtttacaaaaaaagggtttacgttcgatgatgttttattaatacctgcggagagtcatgtactccccaacgaagtcgatttaggggtgcaacttgcaaagaatatcaagttaaacacaccaattatgagtgctggcatggataccgttacggaagcacccatggcaatcgctatggcgcgtcaaggtggtttaggcgtgattcataagaatatgagtattgaacgtcaagcagatgaagtcttgaaggttaaacgttcagaaaatggcgttattattgatccattttatttaacagcggataaacccgttagtgctgctgaagatttgatgcgtaaatatcgtattagtggtgtcccaatcgtttcaaatctcgatgatctaaaattagtcggcattattacgaaccgtgatttacgttttatctctgatttctctgctgaaatcggaaccgtgatgacgcacgaagcacttgtaaccgcacctgtcggcacttctttagaagaagctgaacaaatcctccaacaaaacagaattgaaaagttacctttagttggtgatgacggtcgcttagccggattaatcacaattaaggatattgaaaaagtgcaagaattcccgaatgcggctaaggatcaatatggtcgcttattagttgctgccgctgttggcgtcacaagcgatacttttgaacgggctgcagccttattgaaagcaggggctgatgcgatcattatcgatactgcgcatggtcattcagctggtgtgttacgtaagattagtgaaattcgcgaacgcttccctgaagcaaccttgattgctgggaatgtcgcaactgcagaaggcacaaaagccttgtatgatgctggggttgatgtcgttaaagtggggattggtcctggttcaatctgtacaactcggattgtggctggtgtcggtgtaccacaattaacagccatctacgatgctgccagtgttgcccgcgaatatggcaaaaccatcattgctgatggtgggattaaatattctggggacatcgttaaagctcttgcagccggtggaaacgttgtgatgcttggtagtatgttagctgggactgacgaagcacctggcgaatttgaaatctatcaaggacgtcgtttcaaaacataccgtgggatgggtagcttggctgctatgtcgcatggttcatcagaccgttacttccaaagtggtgtgaatgaagccaacaagttagtcccagaaggcatcgaaggtcgtgtggctgccaaaggtgcactcggcgatgtaatttaccaattacttggtggcttacgttcagggatgggctacgttggtgctgctaatttacaggacctacaagataatgcacaatttgtccaaatctcaaatgctggtttgacagaatcacatccacatgatgtgcaaattaccaaagaagcacctaactattcagcacgttaattcaaatcatttctatcagggtttaagtcgagcgttttgcacgacttaaatcctttttttgtggttaaatgatggggaggatttaaagaattctttaaccctaagtagaagatagtttgttacaatgaaagcgaatcatgcaaaatgatgttaaattaaacgaggtaacgattatgaaaattctaattgtagacgatgataaagaaattgttgaattattaagtatttatgttaaaaacgaaggttacgaacccattcaagccttcacgggtaaagaagccctgactaaaattgccacgaatcccgatattgatttgatgatcttggatattatgatgccgaatatgagtggtatcgaagtcattaaggcggtccgtaaggattcacaagtgcccattattgtggtgtctgccaagacaactgatatggacaagattcaaggcctcctaaccggtgcagatgactacgtttcaaaaccattcaatccattagaagtgatggcgcgggtgaagtcattgttacggcggagccaacaacaagtggccaacgaagtgccggatgtcttagaagttggtccgcttatcattaagcgcgactcacatgaagtgacgacgattaataacaagcaaatccaactcaccgcacttgaatttgggattttatacttacttgccagtcaccccaaccgggtcttttcagcggatgatatttttgaacgggtctggaaacaagaaagtatcgtctctgccaagacggtcatggttcatgtgagtcatttgcgcgacaaaattgaagaagcaaccgatggtgaaaaagtgattgaaaccgtctggggtgttgggtataaggtagaagtttaatggctgactatcaaggagaaaagaacctgcaaaaagtggcactaaccgctaaggaaaagagcgaactctttgccgagggcatcatcacggttattttgttattactattaaatttatcaatcatggtgctgttacaacaggcgattgtgaataatccgcaactaagcggcggcgtatggatgattaaaaacgccattacaattggtccgaatgaatggcatatttggagttggcaaaattggtttgtcatcttgatgggggttgccgatgtgttagtcgtctattggcggcttattcggcgttaccatcaaatgcagatgtggcacgtgattggtgagttgcattatattgccgatggtcagttggaccaccggattaatttgcgtgtcaaccgggatttgcaacgcgtgatcgatagtgtgaacacgctggttgacagcacggtgcgttcaatggaagaagaacgcaagattgaaaagagtaaggacgaattgattaccaatgtcagtcatgatttgcggacgccgctgacttcaatcatcggatatcttggtttaattgaagataatcagtatcaaaccaaggaagaactaaccaaatatacgcataccgctttcgtgaaggcgcaacaaatgaaggtcttagtcgaggatttatttgaatacacgaaggtgcggcaaacatcgacccccattaccaagacaacgtttgatatggagcagatgttagatcaattagcggccagttttgagttagaagcgaataagaaggggatgcagattaatgtaacttgtaatcctgcaccactgatgatggaagccgatactgaaaagcttggtcgagtcttcaataatttaattgctaatgctttgaaatatggcaagggtggcaaacaaattacgttggcggctgaaaaaatcggtcaagaggcgattattaaagtgtcaaatgatggtcaacaaattccaagtgattcattgaaccaactctttgaccgcttttatcgcgttgaagcatcgcgttcacaagaaacaggtggcactggacttgggttagcaattacccaaagtattgtcgcgttacatggcggttatatttatgctgattcgacgccagaattaaccagttttgtgatacacttacctttgaagttaggtcggcggattgatcctcaaactgctggcgcaaaatcagttaaggagtaatgttgtgtttaaaaaattagtacaatatgtaatggtcggcctattggcaattgcacccgttggcggtcttttgagtgcccagactaccaaagttgcagcggcaagtacgccggtgagtttgccgaccacccctcaaatcgatgcgagtgcagcaattgcgctcgacccagcaactggacaagtcttatacgaacaaaatgcggatcaggcgttgccaatcgcttcgatgacgaagatgattacagcctacatcgtgttagcgcaaattaagcaaggtaagttaacgtgggaacaaacggtgaagcccgatgacctcatttatcaattgagtcaaaataaggatttaacgaatgtgcctctacaagcggacggacaatataccgtcaaggcacttttccaagccatgatggtcgcttcggcgaatgatgcagccatgatgctcgccaaccaagtggccggttcacaaaaggattttgtcgatttaatgcggcaaaaagtggcggattggggcattcaagacgcacaactttattcagtgtccggcttgaacaatgaattcctcggcgctgaagtttatccagacagtccggctgatgctgaaaatgaaatgagtgcggcagatgtcgcactcatagcgcaaaagttgttggctgattatcctgaaattctcgaaacaaccaagcaagcgcattttacatttggcgcccaaacaagtgatgaaacggccatgtcaacgtggaacttaatgttacctggcgaaaataatgcaccgcaagactacgtggtcgatggtttaaaaaccgggacaacggacaaagcgggcgattgttttaccggaactgcgacgaaagatgggcaacggattctaacagtggtgatgcatgccaatggtgaagatactggccggcggttcattgaaactaacaagttaatgcaatatgtcttcgatggttgggaacaaaaacaattggcacaagccaatcagagtctcgcaccttataagacagcgacggttaaatatggtcgccaaaagacagtgcaattgattacgaacaaagctatttcaatgtgggtgccaaaaggaaccacagcagccaatattgactggcattaccaagcagtcaaaggtggtgcaaaacgccaattggaagcacctattaaaaagaatgtgcaaattggtcaagtgacaccacaattgaacggtgtcactacgcggtatatcggacaagcgccacaatcacaattacgcactaaaacggcggaccccaaagccaatttatttgttttaatcggtgaagggatcaaagaatttttcacgaacctattttagttggaatcgaaacgcgacacttaacggtggcgcgtttttttatggctacgattataagccgtttcaagcgcagcatgattaaatcgtgctataattaaaaccattcacaaggattttgaggaggacgaaaatggctttaacattagatgcatgtacgttaattctaaaagagcatcatttattgaaaagtgtggcgcttaatggtgacccgactttaaatatgaccggaatcgcgtatgattcacggcaggtaactgaggacacgctctttttctgtaaagggaattttcgtcccgtctatttaacaaatgcaaaagaattaggggccgtaacatatgttgccgaacaagcgattgttgaaggcaacgggatgaacgccttaatcgtcacgaacgtccaaaaagcgatggcggttttatcagcggctttttatgattacccacaagatgatttatttatcgtggcttacactgggaccaaaggcaagacaactgcggcctactttactcaatcgattttacaagcggcgacccgtcaaaaaacagcattattttcaacaattgatcgtgtcttagggcctaaaccagaggatcgcttcaaatcgaatttaacgacaccagaaagtttggatttattccgcgacatgcgcaaagcagttgaaaacgggatgacgcacttagtgatggaagtttcgtcacaggcgtataagaaaaaccgagtgtgcggcttaacgttcgatgttggcttcttcctaaacatttcgcctgatcacgtcggaccaaatgaacatcctaattttgaagattatttacactgcaaattacaattattggtcaactcacgacactgtgtgattaacgcgcaaacgcaatattttgcggatgtgtatgctgcagcaactacgacgactgctccggaatcaatttacttatttgccgaaacggattatcaacctacaattccggtggcggttgatttccgctttgaaaatctagaaacgggcttagcagaaagtcggtttaaagttaccgcggcttctgaacgagccattcagcttggtgtttctggtgattaccaattgcgtttaattggggatttcaatgaaagtaacgcgacagctgcagtgattggtgccggtttggcaggggcggatttaatcgcagctcaacaagggattcgcgacttgcagattccaggacggatggaaaccttagccgttccaggacatggtcaagtatatgttgattacgcgcataattatgccagcatgaaggcgctcttgagtttcttgcaaaaggaatacaatcaaccacgcctactagttgttgtcggtagtcctggcgataaaggtgtttctagacgtgctgggtttgcgcaagtccttaatgaatatgcagatcgggccattttgacgactgatgatccaggatttgaagatccagcagccattgccgctgaaattttggccgggattgaccaggataaggtgacaaccaccatcgaaattgatcgtccaacagcgattgaacaggcgattacggaaagtaaaccgggcgaaattgttgtcttagcggctaaaggggccgatgcttatcagaaagtacgcggggtcgatacaccatatccaactgatatggtgattgccaagcaagtggctgctaagttaagctaatcagcgtgtttcttaaagatttttaaatcagatgtggatttaattgctattctgaggtgtgtttcgtagaataaagatgaatcaataggagttggaggggttattatgaaaaagatggttacagttagtacagttttggtatcaggactactattattaggggcctgtggtcaaagtagtacggcaaatcaagatgctgatgccaagcaaagttcaaccacggctagtctcaaagcacgtgaaagtagtgttgcaaaacgcgaaagtgaactttcaagtagtgcaagccaattaaaagcgagctccaaagcggcgatggcatcttcaactgaagtagagtccccacaagcaagttcatcaactgatacaacggcaagtagcagtagtcaatctgcgagccaatctagcagcagtgcaacaacaacgactaccacgacaccacaacaaacaactgccgtagatggcaaccaagcgattaaattggtggttcaacaagttggctcacaatttggtcaaaccgcatcgtatttgaataatggcttaatcacacgcggtggacaacaaggctatctcattaatatttacgtaccaaacgaagatcaaccacgggcaggttattttgttgtccaagcaacaggtgcagtggaacaaatctggtaattaaagagtgtggcgtaagtcgggatgctccgaggattaacacagagcgtgaataattgtagtaattgtttgcgactcagggttaaccggaggagaatgacttacagaacacgtttaaagttcaacaattcaaaaaaggggttagggcaaaagcaatctttgtcccaatccctttttaagtgttttcagaaaaatgattgacaattagtgagactcgtgtaaaatatttttagtaaaacgtaataattacgatttagaaaagaggagaaaaagatgcgtaaaaaaggtttggaaatcatggcgggaatcttactgctaatgctattagtggctggttgtggtcagagtacgaaaaaggcgagtgggattcaagttgtatcgtcactcgatttttatggtgaggccgcacaagcggttttaggtaatcaaggtcacgtgacgtcgattatcaatagtcccagtttagatccacattcatacgaagcaacaaccaatgatgctaaactcgtggctaaagcggatgttgtgattcaaaacgggcttggttacgacagctggttaaacaaagtcgttaagagtgcccaaccagatgaccaaactatgttgacagtcagtcaattaatgaaacaatctaatggcgctaacgaacatttatggtatgatttaaagacgatgccaacattgaccaagcgattagtgactgaatttagcaagcgcgatccgaaacataaggcaacgtatcagcaaaatggtgcggtgtatcttaaaaagttagcttcgttagacgcacaactccaacaactaaaggcgcaggccaaaggaaaacaagtggctgttagtgaacctgtttttgactatgcattggctgaaatgggttacaaagtcgctaaccaacactttgccaaagcaattgaagatgggactgatccatcaccaaaagatattacaacgatgcgggatttaattaaaacccatcagattgcctttttagtgattaataagcaagaagaaagtcccattattaaacaaatgcacgaactagcggataaagaaggggtgccagttgtacaagtaactgaaacactacccgctaaaaaaacatatttaacatggatgcaacagcaatttgatgcagttagaaaggctcaggattcaaaatgacagaattagtgaatgcacaacatttagggcttgcctttagtaatcgacaagtactaaaagatctcagttttacgatcgaacgtggtagcatgacgagtttaatcggtccaaacggggttggtaaaacaactttggtgcgcctattaatcggtaatttacaaccgacagaaggacaactcgtttttaacccggataagcaaaagctaaacatcggttatgtgccacagtttagaaatttagaagctgaatatccgttgtccattcgtagttttgtgagtttgaatcaacttgatagccacttaccgtggaaatcgcgcaaagaacgccaagcgcttgatcaaattttagaacagacccatctaaccgcgttgcaaaagacgaccgtggggaatgcttctggtggtgaaaagcaaaaagcgtatttagcccaagcattaatcagtaaaccagacttgttgattttagacgaatcgacagcgagtttggatattgaaactaaagaagaagtgatggccttggttgcagagttgaaccgggaacatggtttgacggttatttttgtgacccacgatttagaattggcccggaaatacacggatcaatacctatttttaaaacgaggtcaatatgaagccggaccaatgagtcagttggatcccaatttggaattagattaaagcggaggataagcgagtgttaacttttgattttatgcggcatgcctttgtcgccagtacttttatcgcaattacctgcggtttaatcggggtatttgttgttgcgcggaacatgtcatttctagcgcataccctatctgaaattggatttgccggagcctcatttggggttttcatgggaattgcaccattgaatgggatgttattgttcacgttactcagttcaatcacgattggtcagatgagtgccaaagaatcacggcgagaagcgtcgattagtgcgatttcaagtctgtttgtcggtttggggattctctttttatccctttcaaaccgaaatgctagttatgctaccaatattttatttggttcgattattggcattagcttagcagatgtttatcaattaatcatcttatctggggcaattatgattgggctgttgatcttttaccgggacttggtatttgattcatatgatccgattggcgctcaagcacaaggtttaaagaccaacttactatcgatttatttcttaattttattagccgtcagtgtcagcattgctgctcagattgtggggtcattactagtattcatcttagttacgattccggcgttcattgctaaatatttagcgaagagcgtacccgggatgttggcaatctcggttgccgcagcgttattaggggtttggctcggtttatggcttggttatctaacgaactggccagtgaccttcttcatcgccacgattgagtttggcttttactttattgcattgttatatcatcgacgaattagccgttaaaaaaacgtcctcaatcattgagggcgttttttcatgaggcttaatttaggttagcaagtagggcttcgagttgatccagacgttcttcgaaaactgcaaaagcgcgttcgagatagtcggcactcgtcatatcgacgccggcttgttgcataatttcaattgggtaggcggagctcccagcttttaggtagtctaaatagtgatcgagagcaccgggctgtttggtgctaatgccgttagcgagagtcgttgcagcagcaaagccggttgcgtattggtaaacataatagttcatatagaaatgtggaatccgagtccattcaagggcgatctgtggatcgttaacgacggcaggtccgtagtagcggctattaatgtccgcatattgttgtgacatgaactcggcagttagtggctgaccattggcagcggcagcatgcatcgcatgttcgaactcagcgaattgcgtttgacggaaaacagtgcctttaaaaccatccaaatagtagttcaatagataggcctggaccttaggatcagactgtgtttgcaataaatattccgttaagagattttcattggttgttgacgcaatttcggccacgaaaattggatagtcgccataaacataatcttgggtctgacgggtgaaggcgctgtggacactatgccccgtttcatggaccaatgtgtataagttgtttaaatcatcttgccagtttaataaaatgaagggattggtgtcataagcgccgccagaataggcgccactccgtttcccttggttttcacaaacatcgattaagcggtcatcaaaaatatgggcaacttgtttggcataatcgggtcctaggatcgacaatgcttctttggcagttgcttgcgcctgctcataagtgtaggttaatgcgggttttcctagaagtggtgtgtagagatcaaacatgtgtaattcagataaattaagttgctttttgcgtaattcagtatagcgatgtaaaagtggtaagtgttggttcacttgatcaaccaaggttgtatagacggcttctggaattgctttgggtgctagcgctgcttggcgtgcactatcgtagtgatggacttgagctaagtaattatgacctttgatttcagtggcaagcgtcgtcgcaaatgtatttttgaattgaccataagttttgtaaagtgcttcgaaggctgcttggcggactgatcggttggttgattgtaaaagttggctgtagaccccatctgaaagctgcaacgtttgtccgttttcgtcagtcacttctgggaattgtaaatccgagttgtctaagacgctgaaggtttgactagcagcactgaagatatctccggcagcagctaacaaggcttcttcttgcccagataagacatggtctcgactatcggtaatggtttgaatgaaatggctgtaaactgctaaattaggcgtcttggtaagccaatctgctaattgcccagccggaatagcaagaatcgcaggctctaaaaaggccgctgctgctgaaacttcggccgctaagctgtccacttgggcttgatagccttgataagttgcgttagcagtatcctgatcatttttcatgctagcataaacgtaaattgtttcgagttggcggaaagtggctaagatttgtttgattgtagcgactaattgatcagccgattcaaacggacgatcaagtgttttgagtgtgggtaattgcgttttaactttcttaaaggctacttcaaaagctgtatcatttttgaaaatcgtggttaagtcccatgtgagcttttctggaacagcattgcgggtggggagttgttgagttgacatatgaaacctccataattaagactaattgcttatattttagcataaaagcgcttaggaaagtgttgttcaacaattgaaggaattattaaaattgtgtaacttttcttaaaaggcgttgtttgaaatgataattccgctataatagcaacataacattattaatgccggtatgatacatgatagaagggaaacacctatgcagaattctaaatttttcggatctcgagaagcaaactacaaaaaagttaaaaagcatcgcacgatgaaagttttgatactcattctaacgctagtcctcttcggtggcggcgcgtatgcattacgcatcagtaatcaagtgaagtctgcagcgaataaaatttataaaccaaatacgactaaaaaagtcgctaaaacgattaaacataaaaaaccattctctattttattactcggagtggatactggtgctgagggccgggttgataaaggaaattccgatacaatgattgtggcgacggtcaacccagataaagagcaggtcaagttggtcagcattcctcgggatacgctagcgcagttacaaagcgcaggtgaatttaacatgcagaagattaatgctgcctataatgttggtggttctgatatggcgatgtcgacggttgaaaagatgctcgaggtcccaattgattactatgtcacggttaacatggggggcttatcgaagattgttgacgctgtcggtggcgttgatgttgacgtaccctttacgttcgaatcgaacgggagcgagtttactaagggcaagatgcatctgaaaggaaaagccgctttagactactcacgaatgcgttacgatgatccagaaggcgattatggccgtcaaaaacggcaaaaacaagttatcacgtctatgattaattctgcagtctcgcttaaatctttgaccaactttgaatctatcttagactccttgtcagatagtgttgccactaacctcagttttgatgacatggtagcgattcaagcaaattatcgaaaggcagctaaatcaattgagtctgatgttttaattggacgtaatgctgatattgatggtagttcgtatcagattccaaccaatgaagaaatccaacgcgtttcagatgtcttgagaacgtcactgggattagagaaaacaacgattaacaacgcagaaaccaaacaaaacgatttgaataccaactttacaggtgaagaaaatcatcaagagtttacggtttattctgaaagtgtcatgaatggtgaaaagagtgctgcaacgacgacgcaaagtaactatggctactcgaacagtgcaacttatagtggtaacaacgattacagtaacacgaccaatacttggcaaacgcaacagtctacaaatcagtggaatgcgggctattaaaaatgaatggaaaagcggtcctttgcaaaaggggaccgctttttttgtggactaatttagttgcgtttaacaagtgattatttatgcaattagggggtgaacaatagtttacatttacaagggggaacggtattatttaaagcggtacgaaaaagacaaatgaaggatgtggcgtgtcgtgtatttgcttgtaaatgttgttggattactgatttttattggagtcggctttctgttctcaaagaaaaagaaagaaatcgattggcgctccgtcttaatcatgttagtgattaacttagtgcttgcttggtttttaacgagtttttcaatcgggcgggatattgttttaggtgcagcaaacggctttaactggttagtgcaagttgcctatactgggattgcttttgcactaccaagttgggtcaatgtgaaacaaatggatttcgttgctagcgtgttattaccaatcttgatgattatcccattattcgatatcttaacgtatatcggggtcttgccttgggtgattaaatggttaggccgtgggttagctaagattacgggacaaccaaagtttgaatcattctttgcagttgaaatgatgtttttaggcaataccgaagcattagctgtttcaagcttacaattgaaacaaatgaaagcagaacgaacattaacacttgcgatgatgtcaatgagctgtgtgacagcttccatcatcggcgcatatacacaaatgatgccgggccaatttattttaacggcgattccggtcaacattattaacgctattattgtcaccaatattttaaacccagtgaaagtcacacccgaagaagatacgattgctaaaatgggtgggagtggttccgcagctgttgaagcaaccgaaatggttgaaggcaaagtggaacgtgaaccattcttctcattcttgggtgattcaatcttaaatgctggtaaattagttttaattatcacggcaaacgtcatcgcctttgttgcgttggctgctttgattgacaaggtgcttcaattagtgaacccttggattacccttgaacatttacttggaatcgtgatgttcccattcgcatggttaatgggacttgatgtgcaccacgcttttgaatttgcacaattcatggggacgaagttggtgaccaacgaattcgttgtcatgggtaaagtccaacattcaatcaggagcttcgcaccacattaccaagctgtcttaacggtcttcgtgacatcatttgccaacttctcaacagtcggcatgatcatcggcgccttcaaaggccttgtggaccgtgaaaagaacgacatgattgccaaaaacgtcggctacatgttgctatcaggaatcttagtatccctcctttcagcagcaatagtcggactatttgtatggtaatttaaagagtgcgcaggcagccgggtatcttctgaggattagcctaatcaggcggattaccgacaaagtcggtgatttgactgatgtagctaaccggaagaagatggctgccaaagcacgtttagagtgtgtcattaacgggttgcttttgagcatttgcctagtgttgtgaataatcagcgcagctgattgtttgcaatacgtagcaaaacgcagaaagcagttaatgaaagcacgtttcaattcaatcaatttacggcgccaacttaatcttggtgccgcattattgggctatggccaagcggtaaggcaacaggttttgatcctgtcatgcgttggttcgaatccagctagcccaatccaactagcccaatccaactgcaaaacttgacggttaaagggctttgtgatatattttggacattataataaaatgtagccatcgataaagtacttggttttagcgatcaatcacagagagagtaaccccgttgaaagttacttattgattccagttgacagcttttgaggcttggatgaatatcccgctagcagatagcgttatcaacagctgaaattaaaggtggtaccgtgcgcaaagcacccttgtcgaaagacgagggtgctttttttattttttataaaatgtagattcagagaggattggcaaatatgagaacaagaacaacatattgtggattagttggggaagaatttctcaaccaagaagtcgtattacatggttgggttcaaagccaacggaattttgggaacttaattttcgttgatttaagagatcgcgaaggcatcgttcaattggtgtttaatcaagacacagatgcagatattttccaagtagcaagtaaattaaagagtgaatatgtcgttgaagtccaaggaacagtgatggcgcgtgatgaagcggccattaatccagacatgaagacggggaaaatcgaagtgattgttaaagacttagtggtcttgaacaaagctgaaaccctcccatttgaaatttcagataacaatacggcttctgaagatttgaaattgaagtatcgttatttggatcttagaagaccagaaatgcaaaatgccattaaaacacgggctgcgattactcgtgcagttcacagctattatgataacaatggttatttaaatatcgaaacaccgaacttgacgagttcaacacctgaaggcgcacgcgattatttggtgccttcacgggtttatccaggtagtttctacgcattaccgcaatcaccacaactcttcaaacaattattgatgtcagccggctttgataagtactatcaaattgcccgttgttttagagacgaagatttacgtggggatcgccaaccagaatttacacaaatcgatgttgaaacaacgttcttatcagacgttgaaattcaaaccgaaacagaaggtttattgaaaaaagttatgaaagacgtcaagggcatcgatgtgcaaacaccattcccacgtttgaaatggcaagatgcaatggacaagtatggttcagataaaccggatgttcgttttgatatgcaaattcaagatattacagaaatcgtgcaagattctgacttcaagccattctctgaagctgttgaagcaggtcaatatgtgcgcgcaatcgtcgttaataatgccgcccctaaatattcacggaaagcgttagacgaacaacaacaatacattgaacgttacggcgctaagtcattgttgtgggcgaaatacgctggtgataaattatcaggggcttctgctaaaggcttattaccttaccaagaagcgcttgttgaacgtttgaacttaatggatgatgatttaattttaatcgttgccggtaacttccacgtggtttgtgatagcttaggttacttacgaacacacttcgctaaagaaatggatatgattgataagagccaatttgcatttacatgggttgttgattggccattatttgaatatgatgaaggctttggcaaatggattgcagcccaccatccattcacgcgtccacgtgatgaagatattccattattggatactgatccacataaggcacacgcgatttcatacgatatcatcttgaacggttatgaattaggtggcggttcactccgtatttttgatccagaagtccaagaaaaaatgttatctgttttaggggttgcccctgaagtggctcaagaacgtttcggccacttattaaatgccatgaaattcggtttcccaccatcaggcggcttagcgattggtttggatcgtttcgcaatgttgctcgctagtcgcgacaatattcgtgacgtgattgccttccctaaaaattcccgggccacagaaccaatgaccaatgcgcctagtgaagtgacaccggaacaattagaagaattaggtatcgaagtgagtcctcaaaagaaggactaaccagcatcaaatgaagtcaattaagtaaaggagaattgccatggaagaaatgtttacgattttaggcggcatggggacggcggcaaccgaaactttcgtacatctaatcgatgaattaacaccggctaagaaggatcaagattatctgaattacgtcgtgttcaaccacgctgaaattccagatcgcacagcctacatcctcgacaacagccaagaaaatccgttgcccgtgatgttaaaagatattcgccaaatgaatttgttagcgccgaagttcatggtaatgacctgtaacacagcccattacttctacgacgaattacaagctgccgcagatttcgacattatccacatgccacgggaaacggtcaaacacatgcaacaaacaattcccggcttgaagaaaatcggtgttctcagcacaaccggaacccgacaagccggtatttatcaaaaagcaattgctgcttttggtcttgaaagtgttgttcccgaccaaacattgcaagatgccacgatgagtttgatttatgatgacattaaggcgactgggacattcagccatgacaagtatcaaaaaattgtcgatacaatgttaaatgactatgattgtgacgcggttattttgggctgtaccgaattgagtgttgcacagtcggaatttccattgtatcccgacaaagtgattgatccgatgacagtggtcggccaaaatattgtcgacgggctatacaacaagtagcaattactaattaagttttaacaaagagcatcctgagctgacgtatattgaacggcagtctggtatactacgataaatattgatatagaaggtgacagcatgcaagcaaacggtaaaaacttcacccccattttattggggagcgattttaacgtttacgggatggcccgttcgttttatgagatgtatcatgaacctgttaaggcctacgcaagtcaggaattagcaccaactcggtttacaaaaatcgtcgatttagaattgattccaggcttcagtgaagatcctggattcattactgaaatgctaaaattaaaggaaatctatcgcgatagcgatggcccagtcattttgattggctgtggtgatggctatgcgagcttaatttcacaacataaagcggaattggaagatgtctttgtttgtccatatattgatcacgatttactagaaaagttgacttataaggaaaccttctatgaaatctgtgacaaatatgacttaccttatcccaagacgcacatcattaccaagcaaatggttgaagataatcaggtggaacaacctttccaatatccagtggcgttaaaaccggcggattctgtggaatggcttgatgtgcattttgaagggcgcaaaaaagctttcacgattaaaagtgaagctgaattccaagacatcatgcgaaaagtatatgaaaatggctaccaatcagacatgattttacaagacttcattcctggggatgacagtcggatgcacgtgatgaacatctatgttgaccaacaacatcacgtgaagatgatgtgtctgggccatccattattggaagatccagcacccgcagctattgggaattacgtggcgattttgccggaatacaacgcacaaatttatcaacaagtccaaaaattccttgaagatatcgagtttacgggttatgccaacctcgatatgaaatatgatgaacgcgataacacctacaagttattcgacatcaatttacggatgggccgcagtagtttctttgttaccttgaacggctataacttagcccaatgggtggtgcgcgattacgtgacaaacgacttgcaagatgaacctgttgtttgggcgaataaagatgaagacagtcccgcgctttggttgggcgtttcagtggatgtctttaagaaatatgcccgcaataatgccgaaaaagacaaggcattggcactcatcaaacaaaaacgttacggcaccacttttgaatatagcaaagatatgaatctcaaacgctggctattgattaaatggatgttgcacaattaccgcaaaaatttcgcgaagttcttcaaagaaaataaggaataacgtcgcttaaaactttaaaaagcacatcatcgttgaacgatgatgtgcttttttagcagcattagaaaaaatcccgccgcagggttgcaggtttgtggtaaatgatgcaatatgaagttggagaatcgctgtggcatttatggtttgatttttgaatgagtgctttatttttgagacaaaaacgatataataaatcaaacaataaatttacaatgctagccggtattttgactgtcaattagcgttaaagtgcttttagatgcgattatgaatgtagcaagtaattgaaaaaggtggaaaaacgatgcactcattagatattgagcgattaaaagagatgtcaaactttgaagttgtcgctttgttcttagaaaattcagaaaaaaatacaatgcataatgcaccaattaatgttggtcgtggggaccctaactggattaatacgcgggcgcgattagcttttaataagcttgtcgaatttggcgtcgaagaatctgctaagaaaattaacgaggctgatggagatatggcgggctacgttgataaagcagggattgcacaacggctgcatgcctaccttgatgccagtcataaaacagatcgatttatattagcctttttagattataccgaaaagcacatgggcctcaatcaggatgatttggttcacgaatttgtcgacggtgcgattggcaatcactatccagtaccttcgagaagtttaatcaatgtggaaaaaatcctaaataaataccttgaagtgtcactatataatggtgaaaaattagctaatcaaacggatgtcttcccaacagagggcggaacagccgcaatggtttatttgttcaaggaattgaagatcagccatatcttacggcctggcgacacgattgccatcaataccccaatctttaccccttatttgcaaatcccagaattaagtgaatataaattaaagcaattcgatgtgagttccgttgaagatgacaactggcaaatgatggacgccaagtttgaagaattgaaggacccgacaatcaaagccttttttgtggttaatccaacgaaccccacttcgcgggctttcagcaaacacgcgttagctaagattaaagaggtcgttgaagcaaacccagaaattatcatcattacggatgatgtttatgggacttttgtgaatgatttccaaacaatttactcaattgccccccgaaatacgatgttagtttattcgtattcaaaactttatggggcaactgggcatcgtttaggcttactagcagtgcaccaagataatgtttttgatgaaattattgctaagcgaacggctgaagaaccagcgattaaggcagcttttgaaaaacggtactcagttgtggcgcctaatccgcttgcgatgaaattcattgatcgaacagtggctgacagtcgtgaaatcgcgttgtaccacaccgcgggattatcaacaccacaacaaattttgatggcactatttagtttgaccagcttaattcacgaaggtgaaaaggatccatacatcgaagcttccaagaaaatggttgatgcgcgatacaacgctttttgggaatcgatgggcatggaatgtgatcactctaaagaaaacgctgaatattatgcggtatttaacatctatgattttgctgaaagaaagtatgggcatgaattccacgactatttcgaaaagcacgtgagctatcttgatttcgaagataaacttgcagctaaatacggcgttgttgtgatggatggggcaggaatggggactgatgatggctacttgcggatttcattagctaaccaacccgctgaaaattatgccattactgggaaccggatcgcccaattactagcagaatactatacccaatttcaagcacattaaataaaaagtaggcgctgtgaggcattttttgcaagatagtctgatctggagcgcgcgaggtgctgaggcaataaacattgtctcagcacctcttttttattggcctgcattaataattgaacatttatcgagtctgtttgtagacgacttttaggaatcatgtataataagcttgagataaaatgatttataaaggagtttagcatggccgacttagtttatcagaatattatcgcggacttaaaaaaagcgattaacgcagaatcatttcccagcatgaaattacccgatgaacggacgttgactgaacactatcaagtgagtcgtagctcggtcaaacgtgcgttaaacgttatggctaatcaagggatcattttcaaaaaacggggttcaggaacctttattaatccactttatttaaagggtggctcgttttttaattacaatggctctaacctaggggttaccgacagttttaaagccggtaatcggacaccggggattaaattattagatttccaagtcattaagccgagcgcggaattgcaacgagacttgttcctgaaaccagatgattttgtttacgaaatcaagcgtctccggttgtttgatgatgaaccattcatgattgaaacgggcttcattccgattaaggtaatgcccgaattgaccgaaaaaattgtgtcgagttcaatctttaactatttggaaaccgagaaaaatcaagaagtcacacgcgctttcctgtcaattttcgcggaaccatcaactgatgatgatcaagcgcacttaaagttgaaaccgacggaaccagttggcatcatggaagggattttcttcttagacgatgggacaccgtttgaattttcaacgatgcgcctgcactatcaatacatgaaatataatacattcgttacggttagcggtcgcgaatagggccgctatttttagattcaaaaaattggtacgacccaatattaaaaatggttgacttttttaaaaagtttagtatgataagagagtagtcagaaacaacaaagttgcaaaagctgcgactggaacttaaagtaaagctattaggaacttttttaaaattaaaaaggggtgctattaaaatgacagattattcaagcaaagaataccttgctaaagttgacgcattttggcgggctgcaaattatatctcagttggtcaattatacttaaaagataacccactattgaaacgtcctttggaagcaaaagatgttaaggcaaaaccaattggtcactgggggacaatctcaggccaaaacttcctatatgctcatttaaaccgtgcaattaataaatataacttaaacatgttctacgttgaaggcccaggtcacggtggtcaagtgatggtctcaaactcatatttagatggtagctattcagaaatctatccagaaatttctcaagatgttgaagggatgaagaaattattcaaacaattctcattcccaggcggcgttgcttctcatgcggctcctgaaacacctggttcaatccatgaaggtggcgaacttggttattcattatcacacggtgttggtgcgatcttagataacccagacgtgattgctgctgttgttgtgggtgatggggaagctgaaactggcccattagctgcatcatggttatcaagcacattcatcaatcctaagaatgatggtgctgtcttaccaatcttgaacttaaacggtttcaagatttctaacccaacaattctttcacgcaagagtgatgaagaattaacgaaatacttcgaaggcaatggttgggaaccaatctttgttgaaggcgacgaccctgaaaagatgcacccagcaactgctgctgcaatggatgaagccatcgaaaaaatccaagcaattcaaaagaatgcgcgtgaaaatggcgattcatctcgtccagtatggccaatgatcgtcttccgcgcacctaagggttggactggtcctaagacatgggatggcgcaccaatcgaaaattcattccgcgcgcaccaaattccagtgccaatcgacagtgctgacatgcaacacgttgatgcattagtagactggatgaagtcataccgtccagaagaattgtttacagaagaaggccaattaaaacctgaaatcgcagcaattgcacctaaaggcgatcaacggatggctgctaacccaattaccaatggtgggattgatcctaaaccattacgcttaccagattaccgtgattatgctgtggataattcagaacacggtaaagtcgtagcgcaagacatgattgttttaggcgaatatgttcgtgatatcatcaaagacaacgatcaaaataaaaacttcagaatcttcggccctgacgaaacaatgtcaaaccgtttgaaccatatttttgaagcaacaaaccgtcaatggatggaaccaatcaaagaaccaaacgatcaatacatggcaacagaaggccgtgttcttgattcacaattatcagaacatcaagctgaaggttggttagaaggttatgtcctaactggtcgtcatggtttctttgcaagttacgaatcattcttgcgcgttgtggattcaatgttaacacaacacttcaagtggttacgtaaggctgatgaacaagcatggcgtaacaagtatccttcattgaacgtgattgccacatcaactgttttccaacaagatcacaatggttacacacatcaagatccaggtatcttaacacacttagctgaaaagaaacctgaatttattcgtgaatacttacctgctgatgctaacacgttgttagcaacaatggatactgtcttcaagagtcaagaaaagatcaatttagtggttgcttcaaaacacccacgtcaacaatggttctcaattgacgaagcaacagtcttagttaaaaatggtttgaagattattgactgggcaagtacagaccaagatgctgaaccagatgttgtgattgcagctgctgggacagaaccaacacttgaaagtttggctgcaatctcaatcttgcacaaacaatatcctgacatgaagattcgtttcattaacgttgttgatttattgaaacttcgttcacctaaagtggaccctcgtggtttaacagatgaagaattcgacatgtactttacaaaagacaaaccagtggttttcgcattccacggtttcgaaggcttagtacgtgatatcttctttgaccgtcacaaccataaccttcatgttcatggctaccgtgaaaatggtgacattacaacaccatttgacatgcgtgtcttgaatcaaatggatcgtttcagtctatctaaagaagttgcagttgacgtacttggcgatcaagctggtcaattcgcacaatcaatggatgacatggttgctaaacacaatcaatacattcgcgatgaaggtactgacttaccagaagttgaagaatggcaatgggaaccactccgttaacgcggtgagagtgcgtcactaacggtttgcttttaagcatttgcctaatcaggcggattgccggtaaagccggtgatgtgactgatgtagcaaggtgcagaaagcagttagtgtaagcacgtttaagtggaagagtgcatttgaactggttatcttctgagcattaactggatttgacgaattgacgatgtaatcgtcgatttggcaaatttggttaagcgcaggaagatgggtcaaaaagcacgtttaaatgatagaattctactatcagaagaagggtctgggacaaacgtacttttgtcctagattctttttttgtggattagtggtctctgagcctttatttttaggcataataacggtaaactagtagacaagtataattttagaaagaggcgtttttttatggcaaaaaataaaatccgagtgcggtatgcgccaagtccaacaggtcatttgcacatcgggaatgctcgtacagcattatttaactatttatttgcacgtcacaacaaagggactttcgtgattcggattgaagatactgacacgaaaagaaacattgctgacggtgaaaacagtcagttagataatttgaagtggctaggtatggattgggatgaaggtccagataagcctggtgactttggtccttatcgtcaatcagaacgtcgcgaaatttacacgcctttaattgaagagttagtggctaagggattagcttacgaatcatacaaaacagaagatgaattaactgaagaacgggaagcccaaaaagcagctggcgaagcaccacgttacatctacgaatacgaaggtatgagtgatgatgaaattaaggctagccaagaagctgctaaagcaaaaggcttacaaccagttgttcgtttacgtcttcctaaggatcacgtttacaagtttgatgacattgttaaaggtgaaatcagctttgaatcagatcgcttaggtggcgactttgtcatcatgaaacgcgatgggatgccaacatataactttgccgttgtcgttgatgatcacttgatggaaatcacacatgtcttgcgtggggacgatcatatcgccaacacgccaaaacaattggctgtctacgaagcctttggttgggaaccaccagtctttggtcacatgacattgatcatcaatactgaaacaggtaagaagttaagtaaacgtgatgaatcagtgcttcaatttatcgaacaataccgcgaattgggttacttaccagaagcgatgtttaactttatcgccctattaggttggtcaccagttggcgaaagcgaattgttcaatcgccaagaattcatcaaacaatttgatccaaaacgtttgagcaaatcaccagctagtttcgatcaaaagaaactcgaatgggtgaataaccaatacgttaaacaatcagatccaaacaaaatcatggatctttcgttagaaagcttgattaaagcgggtaaaatcgctgaaaatcctgatagcaaaacgatcgaatgggcccgtcatttgattgcgttataccaagatcaaatgagctacacagctcaaatcgttgaaatatcagatgtcttctttgaagaacctgaacaattagacgccgaagcgcttgaagaattaaataacgaaacagcacccgttgttttgaaggaattcagcgaacgcttgaaagatttaacattattcacagcaccacggattatgcaaatcattaaaggcatccaaaaagatacgaagattaaaggccgtcaattgtacatgccaattcggattgcaacgacccgcgaaatgcatggtccatcattacctgattcaatcgaattgttaggtaaagaccgtgtcctagcgcaccttgaaaagacattagcagaaattaagtagagtgcgtttggttgcgttcagtaactgagtattaataaaaaattggtagtcatccagaattcaggatgactaccaattttagattaagcggaagttggtgcaaccaaaaagcacgtttaagaacacagtgtcttactcgaacgggttggctttgaggattaacagaaaaatgatcaatatgacttttcttagtcatattggtctttttttagataactggaaaagtcagttcgagaaagcacgtttagacgttcaaaatagaacagcaaaaaagctgaggttgaagtatttcttcaacctcagcttttttatttttgtctagtccgatcaatttcagtccgaatggctttgaaactttgttctgtttgtgggccattattaacggcgaccatcataaacagactatcgacgatgctgatttgtgcaattaacgcgtgtagtgcttcggcgcggtaattggtttcttcagaaatggacaacagtgtcacatcacccaatttagcgagggttgaattgccaaaactggtgatgacaatcagtggaacgtgacgttcttttaagatgcgtgcaatttctaaagcatctttattttgaccactatgtgaaataatcagcgcacagtcttgttcggtgagttgggtggcctgcatcaattgtagatggtagtcttggctgtaaacagttggaatcgcagttcgtaaaaatttgtggtagccatcttgagcgacgattccagaagcgcccaagccaaataaacttaagcgcttggcctggttgatataatcaacggcttgccgtaattgtgcttcagtcagtagtgaacgagttgctttgagcgcgttagtattggatgcgaaaattttatcagccatggtcagatagtcatcattattactaatttcatggaagagtggattatctgttggggttgcttgtttagcaagtaacgccattttgagtgcctggaagtttgcgaaggtcaacattttggcgaaacgggaaatagtggccgttgaaacgccacagtcggccgcaaattcttgaatcgttaaactttgattgaaatgttcagtttttaagatgtaatctgcgatttgtttgtatttttcacttaaattcgtgtagtacgcacggagtaaggaatcgatgttttgtgtcattgaagtgccccctattatcgatagtatagcataaaaagcaacgaagaaaattattttctcaaaaattgttgattaaagaaaataatttacatataataaagacattaataaaagtgacatgaaattgtggataaggggactggcaaagatgaaattagcaatgattggtttaggcaaaatggggattaacttggtcgctaacttacgacgtaatgggcacgaggttgtcgcctttgacttaaatgaagcagcggttcaagaagcaacccgcttaggtgcattacctgcaaaggatattgatgatgtggtggcacaattgccacaacctaaaattgtgtggagcatgttacctgctggtaagccaacacaagccacaatcgaaacgttaagtaccaaattgacagccggtgacattgtcattgatggtggtaattcatttttcgaagattctaaacaacacaatgcattgcttgccacaaaagggattcatttcttcgatgccggaacttctggtgggatgagcggtgctaacgcagacggaaacttcatgatcggcggcgacagcgcggaagtcttcaaacagattgaaccgatttttaaagatattgctcaaaaagatggctatctctataccgggaaggctggtagtggtcattatctcaaaatggtgcataatggaattgaatacggcatgatgcaatctatcgctgaaggattcgatgtgttatcacatggtgagtttgaatatgataacgaagcggttgctaaggtttggagtaatggttctgtgattcgcggctggttgatggaattagcggaatctgcttttgcaaaagaccctaacttagaaggcttaaaaggtatcatgcactcatcaggtgaaggaaaatggacattagatgaagccttgaaattacaagtcccaacaccggtcattggtttatcattgatgatgcggtatcgttcacttgaagatgatacgttcactggtaaagttgtcgctgctttacgaaatgaattcggcggccatgcagttgataagaaataagtggtatcctagtaagtagtcagtaaacatcacataaacgaggtaattatgatgaaatatatgattggtgcggatattggaacaacaagtacgaaagcggttttatatgatttaaaagggaatgttaaagcttacgcaaacgttggttatcctttatatcaaaccgtacccgatatggcagaagaagatccggatgaaatttttaatgcagtgttagaagtattgcgacaggtgatgcgcaagggcaacgttcaagccggcgaattacagggcgttagtttctcggctgcgatgcacagcttgattctgatggatgcaaatgatcaaccgctaactcgggcaattacttgggcggataatagagctgctaaagcaagtcaacaattgaaagaaaatgggttgggccaagccatttatcaacacactggcgcaccaatccatccgatggcgccactttcaaaactgatttggctgaaagaagcgcaacctgaattgttcaaccaagctagtcaattcatcgatattaaaacgtatgtcttccaaaaacttttccatacgtatcaaatggattattcaatcgcttcagcaaccggcttgttcaacatttttaatttagattgggatcaacaagcccttgaagtggctggtgtcacacgccaacaactacctgaattagtcgaaccaacggattatgttaaagggattgatccaatctatggtgaattaaccggcattggtgctgaagtaccatttatctttggcgccagcgatggggttttatcaaaccttggagtaaatgcaattgatccaggcgtagtcgccgttactatcgggacaagcggtgccgtgcgagtggttgttgatcatccagtggttgatccaaacggtaaattattctgttacgccttaaccaaggataaatgggtggttggtggaccagtcaataacgggggaattgtcttccgttgggtgcgcgatcaactttttgcacctgaaaaaatcacggctgaacaaatgcatgtttcaacatacgatattttgacacaaattgcggcagaaattccggctggttcagatggactcttattccatccttacttgggtggcgaacgggcaccaatctgggatgcagatgcacgtggatcatacttcggtttgacgcggcaacatacgcgggcgcacatggtgcgtgcagcgcttgaaggcatcgtttataacttatacatggtgatgctgatgattgaggttgtggcaggtaaaccaaagagtattcaggcaacgggtggcttctcccgttcagaattatggcgccaaatgttggcggatgtctttgaacaagacgtcacgattccagaaagtttcgaaagctcatgtttaggtgctgctgtcttagggatgtatagtttaggcttagtggatgatctatcagctgtcaaagaaatggttggtgtgacgaatgtgcatcatccagaagaagccaactttgaagtttatcgcgaactattaccaatctggattcgcttaacacgggaattaaatacggaatacggcgcaattgctgacttccagcgcaaacatatgcaagttaaagagtaacgaagtgaactgggtctgaaagcccagttacttttaacaatattatgatagcgcaaacattattgaaagtagggaaaattatggcattattagtcctattattgggcattatcttattactcgcccttattattcgatttaagatcaatacgtttatcgctttagttataacggcaatggccgttggggttggcctaggtatgccattaacggacattgcaaccagtgttcaaaacgggattggcggtcaacttggtgagctctcaattgtctttggctttggtgccatgatgggtcggttagttgccgacgctggtggcgcgtttagaatcgcgcataccttaatcgatatgttcggtaaaaaaagacttcaaattgcaattatgttggcttcgttcatcattgggattgccttattctttgaagttgggatggtcttgttagtaccaatcgttttcgcgattgcaatcgaagcaagtgtgccaattttgtaccttggaattccgatggctgcagcactttctgtcacacatgggttcttgccaccccatccagcaccagcagcaattacctcagctttaggggcaaatgctggtcacgtattgttatatggggtcctaattgcgatcccttcagtgattattgccggtccactattcactaagattgcaaaacgcttagtaccagacgcattcgcacgccaaggtaatctgacggcacttggacctcagaaaacctttaaactagacgaaacaccggggtttggaattagtgttataacctcattattcccagtcattttgatggctgtcaccacgatttatcaaatggtctttaacggcggaaaattacctaaaaatccaacgatgctggattcaatcgtcggttttatcgggacaccagccattgcaatgaccatttcattgatggttgcgatgtatacgatggggtgggcgcgccggattaaaaccccagcgattatgaagacgattgaagaagccgttaaatcaatcgcgatgttactcctagtcattggtggcggtggtgcatttaaacaaatcctcatcgacggcggggttggcgatagtgtcactaaattattcgcgaatgccaatttatcaccactattattaggttggttaatcgcagttgtcttacgggtggcattgggttcagcaactgttgcgtcattgacggcggcaggctggtcttaccactaatgcaatcagccggtgtgaaccctgcactgatggtcctttcaattggggccggcagtttagcggcttctcacgtgaatgatgccgggttctggatgttcaaggaatactttgatttaagtgtcaaagaaacccttgcaacttggacagttttggaaacattgatttcgattgttgggttaattggcgttttactattaagtttagtcgtctaaataaaagttaaatgacgttggctgttaaagacagtcaacgtcatttttgatagcacttaaggtgggcaattatttgtaatcggttacctaaaaaaacgctgagaaacagttttttttaatcttgttcagagacaacatcaaagagatatgatagaatgggtaaggattaatttgaacactggagacgatcagagttaggtcatcctaaaatcaaagtcattgaatcctaatagttgaacgactcaatcgaagagaaagaggtacttatatggataagaagcagcgagaagattcacaaaagggtgaacttaatcaacaaaagcatgagaaattcatacactatgctgatggcacgagtcttgaagaaattaataacacggttgcgattcccaagaacgctggtttttggcggacgttgatggcctttatgggacctggtgcattagtggccgttggttatatggatccagggaactggatcacgtcaatcgccggtggtgcgcaatacgcatacaccttgatcagtgtgatcctaatatcaaacttaattgcgatgttattacaagcaatggcagcgcgtttagggattgtaaccggaatggatttagcgcagatgacgcgggctaaaaccggtaaaaagatggggattttcctctggattgtcaccgaattagcaattatggcgaccgacatcgccgaaattattggttccgcaattgcgttagaactgattttcaacatcccattgctctggggtgtcttaattactgcatttgacgtcttgctattattactattaatgaaactcggtttccggaagatcgaagcgattgtcgcaaccttggtggccgttattttattcgttttcttatacgaagtgattctagcgcaaccaaatatgggcgacgtaatgcgcggatttgtaccaagtacacggattgttaccaaccagaagatgctattcttggcattagggattgtcggggcaactgttatgccgcataatctctacttgcattcgtcaatcgcacaagcacgtcaatatgaccgtgacgattacgccgaaaagaagaaagcaatcaagtttacagtcattgattcaaacattcaattaacagtcgcatttatcgttaactgtttactattagttttaggggcagcaatgttctttggaactaacagtgatttaggacgattcgttgacttattcaatgctttacaaaacaaagaaattgttgggagcattgctagcccaatgttgagtttactctttgccgttgctttattagcttctggtcaaaattcaaccatcacagggacactttcaggacaaatcgtcatggaaggtttcgttcgcatgaagattccgttgtgggcgcgacgggtgattacccgtgggttatcaatcttacctgttattattttcacggtttactaccatgggaacgaagcacaagttgaaaacctcttgatttactcacaagtcttcttgagtgttgcattgccagtctcgatgattccattgacaatgttcacgagtgatgaaaaaatcatgggcccattcgttaaccgcccttgggtgaaatatacggcatggtttgtcacaattgtgttgacgcttttaaatatctatttgattctacaaacaatcggcctagttggctaatgaataggtgctcattaatccgtaaattgatatggattgacgagcgctttttttgttcggtatgctagactagagataaggtattattttggagggattttattgtttgaagtaacgagtgtgcatatcattattcgactgctactggcaaccttaattgctgggattatcggatctgatcgggaatataagaaccgcccagccggaatgcggacacacattctggtctgcattggtgcgtgtgtgattgcgatgattcagcaggaaatcgcagcgcaaaacgttcaatttgcattagcgcatagtgcgattagtaccaccattcgttctgatcaagcgcggctgattgcacaagtagtcagtgggattggttttttaggagctggaacgattattgtcacccgccacaagattcaaggattgacgacggcggcctcactttgggctactgcgggattaggacttgcaattgggatgggctactatcaaattgcggtgatcagtgcagtctttgtcattttcgtgattgtcttcttgaaaaagattattcacatcaatacgttgaaaaaaatcgaaattaagtataagcataaattggaaaccaaggagtttattcagagctattttgaacaacatcagattcaaattcgcgatgtgaacttctcagtaacgcaaaacgaacgtgatacgatttacactaacgtctatcgcatcgaaattccccgggaaatgcaatatgcagaaattgtggaagatatctcgatgaataagaacatcatgacgattcgaatggtcagtgtctaaaagagtgcgcaagcaggcgtttatatttcgagtattaactggatttgtcgcattggcgatgcaatcgccgatgcgacaagtttggttaagcacagaaatatgcctgctggagcacgttaaaaaaaagtgtgctgtctcaatcgggaaacacatttgcgaaaaaagaagccctctgataaacttttttatcagggggcttctttttatttcagtctaattaaacgcaatttgtctgtctcttggtaagattaagttgagaataattgcggcaagcgcacaaatcgaaattggtgattcaagtaagtattggatcatttgaggcgttgctttcaccaatgattgtggcatgatgatgatggcgatacatagaatgattggaattccgatgatgtacatatcacgttcttgggtgtgtagtgtgcgaataacatttaacccgttgagcatgatagttgaacaaatgatggcgaaaatcccaccaataactggggctggaatcgttgataagaaggccgctaatttattaaagaagccgaagatgataaaccaaatcccggcagaaacgaatacttttttactagcaacaccggtgattgaaataatgccggcgttagttgcataccctgtaactggtgagccgcctaagagtgcagcgattaaacagctaattccttcaccgataatcccgtgattccattgtttcttactgatgggcgaatccgtaacggcactcattgcaaaccaagtcccggtcgtttcggtcattaaaacggcgtagataatgacgaaggtcatgattgctgtcatcgaaaagtgcacaccatagtggaatgcggtaaaacttggcaagctaaaccaactcgcttcgttcacactttgccagtcaaatttaccaagcatggttgctaaaacagttccgcctaataaggcgatgatgatggaactgactttgaagagtttttgtaatttagggaagtagatacctagcgaaacacaaagaattagaatggcgacggtcacaacagccaggagtaagttctcattgatattgccctgtgctttgaaaatgttatcacctaaagcagatggcatcagtgaaagaccaacgatggtgatgattgtgccaccgacgacttgggggactaagctgttaataattttttggaagaggccggtgacgccgagaagaattaacagaattgaaccgacaattgaagcgccaatcaccgttgccatcccgccgtctttagcaccactagcaaagtaaatcccggcgattgccccaattggaacaaatgaagggccttgggaaacaggcattttcatgaagaatttggtttgaagaatcgtaccaatcccggcagcaaggaacgtcgcttgaattaagccggcttttgcatcaagacccatcgccaataaaccggcaatgataacggggggaacgtagacatccattgctaaaacgtgttgtagtcctaagaagccagcttcttgatgcgaaattggctcgtcaggaccgaccattaatttttgagattgttcattcataccagttgtgctccttttcgtggaccagtttaccttgaacgtagacggccttaatttggtgtttggtgtggcggaataaaagttgttcgagttgttcatctggtgtaagacttgcaaagcgtggtggcgcttgaacgatttggaaatcagcaagcaatcccgattcaatggcaccagcttgaatgccaagactagttgcaccaccaacggttgccatataaaaagcttgtttagcactgatccgactgttcgcaacaccgcgttggtcagccgcaatggtggcgtcaaccccgtcttgtcgaatttgggaggccgttacggcttgttgcaaattggcatataagctaggggtataaccaccggcgatatcactgccaagcccaattttaatgccttgattaagtaactcgtgtgcggggagaatcccgttgccgaaataggcatttgagatagggcagtgcgcaatcgctgcttgttcggttttaatgatactttggtcagtagttgtcagttgtgttgcatgtgctaataccgaatgttgattcaataatccgaatgattgcaacatctcagagtctgtatggccgtaacgctcgcgtacataatcgtgttcccagtcgctttcgctgcagtgtgtctgaacggtgatgtgttgggactgtgcaagttgaccgagttgctgaagtgtttcagttgtgcaactagggatgaagcggggggtaatgacgggttgaatgaacccattacgataggtatcttgaattgcttgaacaaaagtttgtgttttattaatggcttcttcaggagaagcatcacgataatagtctggtgtttgatctggattatccatcgcaacacttccgatgaaagcccgttgtcctgcttgggaacaaatttctgcgagtcgtagattcgcagaattgtgaattgttccgaaatatagggcggttgttgtgccgttagcgagcatttcggtcactaagtcttgatacacaggtgtggcgaaatctaaatcggcgtagcgtgcttcaagaggaaaggtataatgattgagccaatcagctaaagggcgatcaagggcagttccagcttgtggccattgtggcgcatgattgtgtagatcgataaagcctggtaacaagaagtgtccgggagcgagtgtgattaagtggtcatgttggcgtgcagctgataatcgctcagagtattctgacgccgtttgatgaataatgtttgtgatttgaccattatcactgatttctatcagtgaatcttcgtgaaatgaactagaaattggtgaatttgcagaaaaataacttgcttttagtgtgattggcaaacttttaaacctctccttttagatggtgtgttgtaagtatatcacataccataatgcttttaaactttaaaatcgttcgccttttgattcatttctaagggtttctttcagaaaacggcacgtgagcaaaaaggtaccctaaaaaatagcagactgctagaatgaacttaaataagctagttgaaaggatgaatcacatgagtttagcagatgaatttgtagaacgacgttttattgtctttcaatgccataagtgccaacatccagcgatggaaatcacgacgaagacagcactagaggataattcagatggctctactaagtttcaaattgaaacaacttgcccacggtgtcaagcaaccgatcaatttgttatcaatgacggtcaagaaggggaaattagcgcgagtgccaatagtggcaaagtcgctaaggttgccaacattaaataaggcaatcgacgttcgctaaaagtgaacgtctttttttgtggcgtaaattgtatataattatgaatacatgaataaaaaggctgaaaacggttgatttattcaaatataattgacattatgccctttaaattgtatatttattctacttaatacaattataaaggacttattgaaatggcgaaatcaaaaaaaattaacgttcaaggtctcgtattgatgatttttgggtcaatcttcggctttgcgaataccacaattgctttctacctaatgggctatgccagcattatttggtatatcttagcggcaattttctttttcttaccaacttcattaatgtttgctgaatttggttcttctttgaaagaatcacgcgggggcatctattcttggttagaagcatccattggtaaaaaggcggctttcatcgggacgttcatctggttagcgtcatggattgtctggatggtgtcaacagctgctaaagtgtgggtgccgttttcaacgttcctccaaggttcagatcaaacagcaacctggcatttattagggatgaatggcactcaagtggtcggtgtcttagggattctttggattttattattaactttcctatcaagtcgtggggttgataagattcaaaagtttgcgtcattcagtgggatggccgttgcctttttattcgccgcattcttagtgattagtgtggcgatttggtttaaaacgggttttcatttggcagaaccgattcatgggacgacgacctttgttaagagtccgatgagtagctatcaaacaccaattgggatgttatcatttgttgtcttctcaatctttgcttacgcggggatggaagccatgggcggtgttaccgatagtatggatcagcctgaaaagactttccctaaagggttaatgattgcgacagtcttcattacattaatctacgcggttgcaatctttatgtggggcatctcaacgaactggcaacaagtcttgagcgggaataaagctaacatgggcaatattacttatgttcttatgcaaaacttgggttatcaattcggccatgcctttgggatgacgacacccgttgcgatgacgattggaacaacctttgctcggattaccggtttaatcatgtttatcagttacttaggcgcatttgccgtcttgatttattcaccattaaagtcatttgttctcgggacacctaaagcactctggccgaacggctttgcagaagttaacaagcatggcatgcctgaaaaagcaatgtgggcgcaagcattattggtctgcattttaatcgcggttatttcatttggtggtaaagctgccggtgacttctataatgtcttgactttgatgtctaacgtttcaacatcgttgccatacctctttttagtgactgcctttccatatttcaaggcacgcaaagatttggaacggccttacgaattctttaaatcaccagttgctgttaaggcggtgacgattgtggtcgacttagtccttgtcttcggaattgcctttacgattattcagccgatgttagaaggtcaatatttagatgccttctggatggtcattggtccgattgtctttacgattatggcccttgctttgtatcatcgctatcaacgaaaagcagtacatggctaaattttttaaaagcgttgaccgatttggtcaacgctttttttgatggcctaattaagggtttgtgaattttaaaagggattaattctcattttattttaatgtataaaggaaaatagttgcattttcagattggttctgttttagaactaatctgatttttaaagactaacataaagccccatctagcgattttttaatttttaaagaaagttggttacctaactatcacattagaataaaatgagaataaaagtggacggtgtgtaactttcacaataaacctgtatactttttagatatagtttgcagaaaatgaaatcaaagggggattctatgactgtcaaattacaagtcaaaaatctaacaaaaatatttggtaagcgcgtgccgcgtgccaaagaattactgaaacaaggaaaatcaaaagcagcgattctaaaggaaacaggtgcgacaatcggtgtcgaccgggctaacttcgaagtagaatctggcgagatttttgtcattatgggactatctgggagtggtaaatcaacattggttcggatgatcaaccggttgattgagcctactgaaggtagtgtattaatcgatggcgaggatttaatgcagattgataagaaggcattacgtgaagtccggcgtaaaaagatgagcatggtattccaaaatttcgggctctttccaaatcgaacgattctcgaaaatacagcctatgggcttgaaattcaaggcattgataaggcgacacgggaacaaaaagcgaatggagcactcgatttagttggtttaaatggttatggcgatcagtatccgacacaattatctggtgggatgcaacaacgggttggtttagcgcgtgcattagcgaacgatgctgagattttattaatggacgaagctttttctgcgcttgatccattgaatcgttctgacatgcaagaccaactactcgacttgcaagaaacgatgcacaaaacaattatctttattagtcatgatttaaatgaagccctcaaaatcggtgaccatatcatgattatgaaggacggggaaatcgttcaaaccgggacaccggaagatatcttgacacggcctgctgacgagtatgttgagaaattcatcgaaaacgttgatcgtagtaaagtttacacggccggcaacgttatgattcgcccaacgactgttaatattgaaaaagatggccctcgtttggccttaaaacgaatgcgtgaaaatgaagtttctaatgcttacgttgtcaacagtaaacgtgagttagttggaattattgacgcgcgtgatgtgcttgaattagtccgcaaagaaagtcgtgatttgcaatcaatcgtgaatactgaagtcccaacaaccgatgaagagacaccaattgctgatatcttagatgatatttcgcaaacgggcattccttttgctgtcttaaatgataagcaacaattacgtgggattattattcgcggggccgtcttaggggcacttgcaggaaacgaggtgaaccattttgcttaatttaatgatgattgctaaattacctattgccaattggatggatcactttgtcgattggctgacacaatttactggcttttttaatggtttaacgaattttattggcggaattatcaacgcttttcaatgggtgtttgatttaatccccatctggttattcatcgtgattatcgctggcgtcacttatttagcgaatcgcgacaccaaaaaatggggtttaattatctttgaagtcctcgggctactcttgatttggaaccttgatttctggcgggatatgacgcaaacgttaacgttagtgttaacatcgagtctgatttccctcgtaattggggtgccacttggaatttggatggccaaaagcgatattgcccaggcaatatttaaacccatcttagacttcatgcagacaatgccggcatttgtttacttaattccagccgttgccttctttgggatcgggatggtcccgggcgttttcgcatcagtgatttttgccatgccaccaacggttcgtatgacaaaccttgggattcgccaagtgccaaccgaattgatcgaagcctctgattcatatggctcaactgaatggcaaaagttaattaaggttcaattaccattggcgaaatcgaccttaatggctggggttaaccaaagtatgatgttggccttatcaatggtcgtgattgcgtcaatgattggagcaatgggcttaggaacacgagtttactttgctgttggccggaatgatgctgggggcggttttgcagccggcttggcaatcgtcatcttagcgattattattgatcgtttaacccaagctttgaaccggcaacgtaaacattaaggagggattcagtgattaagaagaataaattaatagcttttttcaccttagtggggctcgtcacacttctaacggcctgcagttcgcaaactaagccgtacgctaccgatgagaaattaggcggtcaaattaattacacgattaccggaattgacgcgggtgctgggattatggcatccacacaaactgcaattaacaagtatcatttgaatgatcagaactggcagttgcaaaccagctcaactgcggcaatgaccagtacgttagacaaagcgattgcggataaacgcccaatcgtcattactggttggcaaccacattggatgtttactaaatatccaatcaagtttttaaaagaccccaaaaatgtttttggtcaagctgaacacattaatacggttgttcgtaaggggctaaagaaggatatgccagaagcatataccatcttagatcgattccattggacgccaaaggaaatgtcgaccgtaatgcttaaagtcaatgacggtgttgaacctgaaaaggcggcgcgcgattggattcaagacaatccagaaaaagttgctgagtggactaagggtgttaaaaaggttcatggcacgaaaattaagttaacctatgtggcttgggattcagaaatcgcgtcaactaacgtggtggctgaagttttacgtcaacaaggttatcaaccaacgattcaagctatggaaattcaaccgatgtgggcgtcagtcgcaactaaagcagccgatgcacaagtttccgcatggttaccgaagacctctggtttatactacaaggattacaaaggtcagattgaagacttaggtccgaacttagagggtgctaaggtcggtttagctgtaccgaagtatatgacgaatattaattcgattgaagatttgaaaacaaaatagaatcaaacagcgtatgcgatctgttcagatagaacatggttagatgatcaaatttcggctgttgaaagagtcggttagggcaaaagttacttttgttccaaccgactctttttttatttgttagacattctctgttagaataggactattgaatgttatcggaggcggaatagatgtctgttaaggcgtttttagattttatcgaattacgcactaaagttggtagcgtgattccctttatggctgggttcttttttacgttgtattatttccaccaaattgatccgatcaataccgtgttgtacttctgtgcattggtgttaattgatgtcttcacaacgggatggaataattacaacgactttcacctcgctaaaaatgaaacgctccagcaatcaaccagtgcattaggacgacaagatattgcccctaaggttgctttacgctggttgatcggctttataagtacggcaaccgttctggggctgattctggtctggcgcacaaatttaattgtgttagccatcagtgttctgttcatcttaatcgggattttatatacttacggcccattcccaatttcacgattaccactgggtgagttgttatcgagtctggtattagggttcggtaatttctttttgacggtgtatgtcaacgttccggcggatcagttggtcgatttgcgctttgatgggccgttaatgttattccaactgaattggctgaatgtgattttggtgtttgtggcgagtttaccaactgtcttcctgattgctaatttgatgttaatgaacaatatttgtgattacacagtcgatttagagaatgggcggcacacattaatcagttacattggtcaaaagcgcggcattcaactttatcaacttagtgcgtatagttgttacgtggtgattattgttgggattggcctgaaattatatccatggccagcagcgctagcttttgcgagtggcccaactttgttacgtaatgggtttgcattacagaagagtcaggaaaaacgcgttgtatttggtacagcggttcagaatctaattgtctttaacggtttttggctagtgggaatgttgattggcctctatctttaaatgaaaagtcactgcggtggcttttttatttcaaaaaaagtattgattgtatatacaattttgattataccgtgattattaaaacgcttacatgtggagatgagagttatgacatatgcaatgattgggacttggcgaatggcctttgaagggattcaaaaagcgatggctgatttaaaaaatggtgggcaaagtacggatgcaattgaaaccgctatcaaaaaagtggaagattaccccttctttaaatcggtcagttacggtggtttgccaaatgcgcaaggcttagtggagatggatgcggcattcatggatggcaacacttttgcaattggtgctgttgcaggaattagtgatgtgaagaacccaatctcagttgcgcgtcaattaagtgacgatcattttaatagtttcttggttggtgcgggagcgtcacaatatgcgatgtttaacggttttgaaagccgtaatatgttgaccgaacgcgcacacaaaatctggatgcaacgaattaaagaaattaacgaaaaaaatcttagcccatatgatggtcacgatacagttggcatggttagtttggatcaagctgccggtatggcagcggggacgtcaacttctggattatttatgaaaaaaccagggcggactggtgattctgcattatctggcagtggcttttacgtggatagcgaaatcggtggcgcaaccgctactgggttaggcgaagatttaatgaagggctgtctttcatatgagattgtgcgcctgatggggaccggtttatcaccacaagcagcgtgtgatcaagcagtctatccgtttgttgagaaattaaaaaaacgctacggcaaagctggcgagttttcgttggttgccttaaataatcaaggtgaatggggcgtggcgacgaacgttgagtttacgtttgcagctggcaatcaagatgcggcaccacaaatttttatggctaatccagggccaagtcaaacgacggtgatcgaacccatttcagcagaatggcttgaagcctacgcgaaacggattaaagcaccagttgaatagaggaagtggttggaatggttaagtatctatacgttgaaattgcagaagccttacgagatgacattcaaaaaggggtctatgggatccatcagaaattaccatcggaaacggatttagccaatcaattttcaacgacgcggctaacaattcgcaaagcaatcgatctattggttaaacaacatgtcgtggtacgcgatcgaaatcgtggcacctatgtacttgcaacacaaagtaaaatttcgagtggttcatctggtttagttggttttaccgaagcagccaaacagtttcaattggatgtcagtacgcgggtgttagatttacgccggacaatcgtttatccggactatgtggcctccaagttagatttagcaccacaggagccagtttggcagattgaacgcttgcgaatggcagacggtgaagcgatgacccacgaacaaatctatctgaaacaaaaaattctaccagaattaacggcccatgaggcacaagggtcactctaccgcttgattgagcaaacaatcccaatcgggtatgccaaccaagaactcgaagcagtcgtattggaaaaaggcttaagtgacttacttgagacctctccagggcaacccgcttttctagcccacacggttgcgtattcaatggacggttatccaattctttatgataactcgcattatcgtgctgataaatacacgttccataacatcttgcaacgtgaacattaaaaggagggttttaaatgaaagtaattgtcttgttggatcaaatccaagctggattaggtggtaaggaaaaaggggatacccctttaggtggaaaaaaattagcgatgggtgctgcggatacgctcgataaggcattaaaaaaaatggactctgaaattatcgggaccttttattgcggaactgattattatcaggcgaacaaagccgaagtgaatcggaaagttgcgaagatgagtgagaaaatgggcgcagacgttgtgattgcgggaccgacctatgattatcgggacttttcgacgatggcgtgtgaattagcagccactattcaaaaagaaacaacaattccggttgttgggctgaccgcgatcgaaaagaatgccgatttaattcaacagtatcaagatcaaataacgattgtgaagatgccaaaaaagggtggtactggtctttcggattcaatcgaccacgcattgcagttatgcaaaatgaaggttgaaggcgctgattttactgattttattaaccaatattgttattaaaaggaggcaaaaccgatgcaaaagaaactcgaacagattttgatgccggttgcaattaaactggggaataatgttgtactccgatcattgcgagatggtttcttaatcattacgccattgattatcgtgacatcgattttcttactgattgggaattttccaattcctggttggactgaattttggagtgggattttagggccgcactggacagaatggtttagtgctgtttctaatttagtgtttagttttacagggttgcttgcttgttttgggatatcctatgcctatggtaaaaaccgagggttacaagcgattcataccagtgcaattgctattatttcattcttaattttgacaccgactgttgtcaccgttggtaaaaaatcaatcggtgccattcaaacaatgtatttgggacctaacgggattttcctagggatttttatcgcattagtcagtgttgaaatttaccgttttgcgattaaacgcaactggcgaattaagatgccagatggtgtgccacctgcagttagtgaatcattcgatgccttactaccggctggcttagtggtattagttttcttcttaattcgaattggttttagcctttcgagtttcgaaacggcctacaatttcatctacacgttactgcaacaaccgttaaaaggtgccggcaactcattgccatctgtattgctttataacttcatcgtaatgttgctctggtgttttgggattaatggtccaactatcaccaacagtgtgtggtcaccaattttcttcgttctgacgcaagataacttaacagcattccagaatcatacgcagttaccacatattttcacccaacaatttattgacatcttcaccacatacggtggcggtgggagtaccctctcactcttaatcgtcatgttaaccgtctgcaagtcaaaacgcgtcaaagaattgggtaagttggcaattgtccccggtattttcgggattaacgaaccgattatcttcggtttgccagtcgttttaaacccaattattgcaattccattcattatcgtaccggttttaaatacattgatttcagggattgtattccaactcggatgggtaccgtatacaaatggcgttatgttgccatggacaacaccaccgattatttctgggtggctttcaactgggagttggacagggtcagtcctccaattatttgaattagtgcttggaattttaatttactatccatttatcatgatgattgatcggcagtatttggcggaagaagccgaagcggctggcttagacgatgttgatattaattttgacgaaatttaatagaaagaagccattcttgtgaaaccgattagagcagattttaaggcattatttgaagcacatgctgatgagttcttagcggacttgcgggaagtgttacgcgtgccgagtgtgtggagcgcaaacgtttgaagcgccgtttggaattggtccgaaacgcgcattggaaacagtgttggcgattgctgatcgaatgggctttaggacggggcaagtcggcaattgtgttggctgggcagaatatggaccagacgaaacgcaagcgccaacttattttgggattcttggtcatttagatgtcgtggatgttgaagatgattggcattatccaccatttgaactgactcaggtagataatatgctgtatgggcgtggtgttttggataataagggaccacttttatcgacattatttgccctgtatctgattaagacgcaaaagataacatttaaacaacgcgtccgaattatttttggcactgatgaggaatctgggagtcaggatatgccaatttatttggcggaacattccgcaccatatgccggattcacaccagattgtaaatttccagccgtctacggcgaacggggcttgttagatgtccagttagcgttaccgattacggacggctctgagcaacaaattacggcggttgaaggacggttcgctaaaagttatctgccagatcatgcacagctgattttggccgatggcacggttaaaacttatcacggcaaaaaggcacctagcaatgcccccgaaatggcggataatgtgttaccgaagttagttgccgatgcaagtcaactcactggtcaaacgggtcaattttatcaatgggtagccgctaaaatcgggacgcagtcaactggggaaaacttggggattaattatcaagatgaagcatcaggagcattgcaacttgctttttatggggtatcgattgaagcccaacagttaagtatgcatctgacatgtcgttacccaatcccagtgacggaagatcagttgttaactgggattaaagctgccatgttgccggggatgacgttgacggttaaacggcgttatccatcgcaagttactgatccaacattgccatttattcaacaaccctctgcgatttatgcggcagatactggtttggatggcacaccggtcacaacaacgggcgtgacttatgcgcgcgcgttaccgaacatcatcgcgtttggcccatcatttccaggtcaaaaagggattgcccataaaggggatgaatggcttcaattcagtgactggcaaatgatgatgcagctttattatgatagcttgctcgcagtcggtactggaacataaaaaagcgtgtgccataagtcaggataccctgaggattagccggaaggggatgacttataagaacacgtttagacgattaaagttctaatatcaaaaaaggggctgagacaaaatttacttttgtctcagccccttttactgtttagcgacttgctaatgcgcccattggatcccatggtgcgagaacggttgggtgatcgtattcttctgtttcaatgcgtttcatttcatccgttaagaagcgtttgttgatcacgatttgataaacaaattcgtcaaaccaactatcactcatgacgaagtaacctttcgtcccaactttgtcaccccatgagttttcaaccttccatttggttggttgaccatcgacgaggtcgacaccggtgatgaccatcgcatgggtcatgagactttcaccgtaatcaaggcgttcgcctttagaaattgaaagatccatgccgagcatggcatctttttgataaatttcagtgtccatgatgccgagtttgcgatcagatgattggcctacatcgctaccgaaccaaacggattcacctgcttgtagttgtttaatcgcgagttgtttgaaagtgtcgatgtcgaggtttaaatgccgcacttcacggccaccgaccacattgcccaacatttcaacgctgtataagtggttgtatggtttgtcggcagttggtgagttaatcaatgaaacgtaattttcgaggtcccagccaacgtatttttgatagaacgtttgcggtgtgaggcctttttcgatgtgatagttgtgatcatcatcgcggtattcaaagtcgaattcaacgggtggttcgcccaatgcataaacgagcatccggtaaacttcggttaacatcgcgtcttttttagcttggatgtcggcttcgctaacaccgtcggctactaattggcgtaatgtaacggcatctttacggagtttaaggttcaaaacgccgttgagttcgcttgatttttcactattatatgtttcgggcatgactgacttaggtacaatcccgtatttttcgatgagtgcgcagagcatgtcccattggccgccatcttgttggggcgttgtcattaagaagtcgactttgcggtcgccaattggttggctggcagtcttcaagacgttttcgtagaagtagtttgatttttcgaatttgtcccagaagttggtgtagttttgggacaattcgaaatccttaattttgaattggtcttggaggctgtggcgcattgtatttaacgcggcgaacatccagcaacgaccagattgcttttgattggaaacggcaccggtatctaagtcgattgaaaaaacgggggccattttggcttttgaatcggtattagcactcgtggctaaaaagccgttgttcataatggcatttttaattgtgttggattgtggtgttgccttgaaatcggctttgaattgttgaatatcttttgctgtaatgggttgaaccatgtggaaaacctcctctaaaatttggtgggttaaattaaattacccggtttgaatggcattatttttttgaaacgtgctttcatcaacaacttcttccgccttacctcacttgccaaatcggcgactgcattgccaattcgtcaagtgctgtaagtgctcagaagtaacccgttgatggcgcactctgatttgaaacgtgctccgtaagccatatccttccggttaaccctgaacgtcaaacgattgctggcgcaatccttcgccgttctgtgttaatcctcaggataaactcggcttactacgcactctattgcagtgcgtcccatgggtctagcttaattggggtttttgtgagtgcggcttgttcttcttttgtaaggtacgcttttttgacaattacctcgtaaacgtagtcgtcaaaccaagcgtcgctcatactgaagtaaccttttgtaccgactttggcactccatgtgttttcgactttccatttcgttggttggtcgtttacgaggtcgacaccggtgagggtcatcgcgtgggaaacaacgccttgtcggtagtcaagtcgttggtcttttggcatcgtcaaatcgaaaccaaagagtccagaatagtcgtaaaggttgcgatcaagccagcctttttgtcggtccatatccgcgagcacgtcattgccaaaccaaattgtttcaccgttttgtaaggattggatagccagtgcttttaaacgttcagggggtaagtttaagaggcgcattgggtgaccttcgactaccgtgttttgcgattctaaactgtagagttggttgtattgtttacttgtttgggggctgctgacaacggtgatgtagtcgtcaaagttgcgattgagatatttttgatagaaactttgcggggttaaaccgcggtcttcatggtaattttggtcgtcatcgcgataggtgaagtcaaacgtttcgactggttcgccgaatgcgtaaacacatagccgatagatttcacttaagaaaccagtccgcgtttcactgatggttgcttcgctagcgttgtcagcaacaagttgccgtaattgaatcgcatctttgcgcagtttcaaattaagagtgctgttgaattcagtggttaagtcactgttataagtttcgggcatgaccgacttgggcacagcaccgtatttttgaatcagtgccactgcgttgtccattggccaccgtcaaaatcgggaccagcgagggtgaaggcgacttcgcgatccgtaatcggcttgtcggcagttgctaaaatcttttcataaaagaggttcgccttttcgatgcgatcccagaaagatagataattttgggagagttcgaaattcttaacgtgatatttctgttcgaaatcgtggcgtaatgtatttagagtggcaaataaccagcaccgcccactctttttttgaaagctgacatcaccagtggggaggtcgattgagtaggttggatcaagggtgacggcagcatcggggcgttgactaacggcgttaatgccattcgtcatcacagcatttttgagcgtcgttgcttgtggcacgccagctaaagcggtccgcatcttgattaaattattatgtgtaatttcttgggtcatctaatcactccttaatttttgaattagtttaattctagttgattagatgggagatgtaaaccgaataacggggataaagctaaaataatggtgattgataaatgtgaaagaaaacgatttatatgagagcacgggacacaaaaaaacgaaccgctgagggttcgtttggaaacgtgctttttaaagctgacgcttgcgcttagctacgtattgcaaacgaccgattttgtcggtcatttaaaacactgtgctagtgcacagtgtcaaatctgctttaaacgcacgctttattttgctgttaaaatcttcacgccatcaggtgcgccaactacgacttggtcgacgatgtctaggaataggccatgttcaacaacgccgacttgttcactgagccatgatgccagtaggtggggatgttggacttggttgaggtgtaaatcgatgacgtagtttttagaatcagttaagacgtgttggccgtctgcagtcatccggaattctggatttaagccttctttagccattttgttgaacacttgttggctgccaaatggaatcacttcaactggtagtgggaagcgaccgattgtatcgaccactttttcttgatcgacaatccaaatgttgcgggttgaagtagttgcgactaatttttcgaataagtgcgcagcaccgccgcctttaatcccttggaagttggcatcgacttcatcggcaccatcgatggttaaatcaatgtggtcgacatcgttgagtgctttgaccggaatcccaagtgatttggcttgttcttcagtacgaattgaggtgcagacacatgttaagttgaggtgttctgcttgtacccgttttgcgagggcttccaccatgtaaactactgttgaacctgttccgagtcctaaaatcatgttatcttcgacaaaatccactgagcgttcagctgccatctttttcattgcattcttatccatcaagacaccccttttgtattaataaatctattatacgaaaaaaacgctttaattgggcgctttttgttaaatttttaattaaatcagtcttaggcattattcacagcctccgcggtttcatggtatgatacagtggtacaaaaagaacccaaatgggcgataatattaggagttttaggaatgaaaaaacgcggctttgagattgtgaccaaataccaagaggcgggattgagtttaccggtgcgttcaacagcgcattcggcgggctacgactttgcttgtgcggaggacttcgtgttgccatcaatctggcattacaactttgtgcgtttgttccgaatgattcgaaatggcaaaccgttagtggatgacgattttgaacgcgcatcaaaaacgttgaaaccctttctagtaccgaccgggattaaggcttacatgcaagacgacgaatatttaatgatcgccaaccgttcaagcaacccactcaaaaaagggttaattttacccaacggcgtcggcattatcgatgcggattactacggcaatgatgccaacgaaggtgaaatttttatccaaatggttaacttcagtccgcgggatgttatcttgaaaaaaggtgaacgaattggacaaggcatcttcatgccatatttagtcgcagatgatgaagcgacggtaaccaccaaacgaacgggtgggtttggctcatctggtcgctaaacggtaatcgctaggtcgccgaaaattcacaaacttatgttaaaataaaactaatctcgataatgaaggagaatctttgtggctaaaattaagactcagtttgtttgccaaaattgtggctatagttccccgagattcttaggtcggtgcccgaattgtggcgcttggaaccaaatggtcgaagaacgtgaacaacctgcagctagcgcgaaatcaagttttacgatttcagggcgggcaactgaaccagaacaaatcagcaccgttaatattcaaaaggaaccgcgtattaaaactgaattaaacgaactcaaccgcgtgcttggcggtggagtggtaccgggctcattgattctaattggtggggatcctgggattgggaagtcaacgttactcctacaagtttccggacaacttgaaaaggttggtaagattctttatgtttctggtgaagaaagtgtatcccagattaagatgcgggctaaccggcttgatgtgaatggcgatcaactttacttatatcctgaaacggatatgggcaagattcggcatcagattgaaacaatgaaacccgactttgtggtgattgattcaattcaaacgatgagcgaaccagaagtgatttccgcagtcggtagtgtttcacaagtgcgtcaagtcaccgctgaattgatgcgcattgcgaagacgaaccagattacgatttttgtggttgggcatgtcactaaagaaggcgctattgccggtcctaagattttggagcacatggtagatactgtattgtactttgaaggggatacgcatcatacttaccgcattcttcgctcggttaagaaccggtttggttcaaccaatgagattgggattttcgaaatgcgtgaagccggcttaaaagaggtcgcgaacccatccgagattttcctagaagaacgtttggcaggggcgacaggttcagccgtggttgtttcgatggaaggcacgcggccgattttggtcgagttacagaccctaattaccccaacactattcgggaatgcaaagcgcacgtcttcagggttagatcataatcgggtctccttgattatggcggtgctcgaaaagcgtgctagtctcatgctatcgaaccaagatgcgtatttaaaagcaactggcggtgttaaattagatgaacctgcgattgatttggcgatggctgtttcgattgcatcaagctatcgggataaagaaatcccaccaactgattgtttcgttggtgaaatcggcctgactggtgaaattcgccgggtcaaccggattgaacaacgcgtcagtgaagctgctaaattaggctttaaacgtatttatgtaccaaagaataacttacaagggtgggacgcaccgacggatatccaagtgattggtgtgaccacgattgcagaaactttaaagaaagtattcaactaggcataagttggagcgagaggaggttgaacgatgcaacaaaaacgatttactaaaaaaagaatattaggaattgtgttcattatcttaggaggtgcgcttggaattacggcgttcccagtattttggccattagttcatttggaagacatgatgtatctcaataacggtattactaacgccattttaggggccattattttctatctattattcttggcgctggcaacaccaatgttgagagccatgcaccggcttgaaaaagccttaacgaaacaatcacctagttttattttatttgggagtgttttttcactaattggattgttattagcaaacgttgtttcaattccgctataccggatgcccatttttgcattaaatacagttgtgcccattttattgatgattgccttagggtatctcggctttcgaattgggacaacgcgaatggaagaatggcgccgtttgatgcaacctaagaaacgcaatgctgatgtattagaacgtaaagtcggcgataatttccgtaagtataagattctagatacgagtgtgattattgacggccgaataaaagaaattgctaagacgggctttatcgaaggcacattgatggtgccaaactttgtcttacatgaactacaattaatttcagattccgctgataatttgaagcgggcacgtgggcgccgtggattggatatcttaaacgatattcaaaaagatgatagcttgtctgttgaaatgtacgacggtgatttcgaagatttaacggaagtcgatagtaaactcgttaaattggcaaaattacttgatgggattgtcgtgacgaatgattataacttgaacaaggtctgtgaatttcaaaacgtaccggtcttcaatatcaatcaactcgctaatacgttgaagcccgcagttttacctggagaagcgatgaccgtgacggtggtgaaagccggaacagaacgacaacaaggggttgcttatcttgatgatggcacgatgatcgttgttgaagatggccaacattacttaaataaaccgctagaagtcattgtgacaagtgcgcttcaaaccgctgcggggcggatgatttttgccagaccagcgcatcaacaaaaaggcttgaaagaaaaatagccacgcagaacactttacacggtcgtcaataatctgtatcatggagaccaactaaaccgttaaaattgatgaagagaagaagtagatgatgccaattgttaagagagctttcgaattgctggaagaaagccgattgacccatcgaaatgcacctctgaaatgccaagtgactttgtgacttagccgggacaccgttacctgttcaaggcatttttgcaaagaaaagtggaaccacgctcaatcggcgtcttttgttaaccaacaaaggacgctttttatttggaagagtgcgcaataagccgggtatcttctgaggattagcctaatcaggcggattaccgacaaagtcggtgatttgacggatgtagctaacacaggaagatggtttatgaagcacgtttaaaagcagagtgcgtttggttgcggtcagcaactgagcattgataaaaaatttcgaataatcccggttttaggattatttgaaattttagattaagcggaagttgttgcaaccaaaagagcacgtttaagaaaggaagattcgatgttaaccgtttataataccctcacacgtcaaaaagaagtcttcaaaccgattcaagcagaccgcgttaaaatgtacgtctgtggaccaactgtgtataactatattcatatcgggaatgcgcgcagtgcgattgcctttgatacgattcggcgctatctcgaataccgtggctatcaagtcgattatgtctcaaactttaccgatgttgatgacaagatgattaaggctgcgaatgcggaacaaatcacggttccggaattagctgaacgctatatcaccgcttttaaagaagacacccaagcacttaatattgaaacgacgacgctcaatccgcgggcgacagaaaacattccagaaattatcgcgttcattcaagatttaattgataaaggttatgcctatgctgttgatggtgatgtttactatcgtgcccgtaaatttaaggactatggccatctagctggtcaagatatcgatcagctcgaacaaggggccagcgaacatacagcaaccgaagaaaccctacgtaaggaagatccaatcgactttgccctttggaagtcagaaaaagggaccgacattgcttgggattcaccttggggtaagggtcgaccaggctggcacatcgaatgttcggtcatgtcgaccaaatatttaggcgatacgattgatattcatggcggtggccaagatttagaattcccacatcatgaaaatgaaattgctcaaagtgaagcgaagactggtaaacattttgtcaactattggttgcacaatggctttgtgacagtcggggatgatgatcaaaaaatgagtaagtcactgggcaacttcgtgacggtgcatgatttgattcaagaagttaatccacaagcattacgtttcttgatgagtagcacgcaatatcgccgaccaatccgctacagtgaatcattgttagctgaagcgcaaacgaatctggatcgtttaaaaacgaccctcgataacttagcgttccgccaagcgactgctgaagcgggcgtagacgcagatgttgctgcacaagcggcaagtttggaagccgcctttttgacagcgatggatgatgattttaacgtgcaaaacgggttaacggaattatacgaactcgctaagttaagtaatcaatatttggaacgcgcaaccgtgcaagctgatacgctcgctgatttaaccgctcgtttaactcgtttattggcgatttttggtgttgagtttaagacggcccaactattggatgcagaggtcgaaagcttgattgaagaacgcaaagccgcacgggcagcaaaggattttgcccgcagtgatgcgattcgcgatcaattgaaggatcaagggattatattggaagatacaccacaaggaatgaggtggagacgcgcatgaaaaatgctttacaactaaacgggattgcgttggcatatatgggcgattcagcctacgaagtatatgtccgcgcccatttgctagaactcggtttaaccaaaccaacgcgcttgcaacaagtagccacacattatgtgtcagctaaagcgcaagctgctttgattggtttaatgatcgatgataattatttaacagaagaagaaatgaatatttttaaacgcggtagaaatgccaaaagttatacgaaagccaagaatacgagtgtttcgacttatcggacctcaacaggctttgaagcagtttttggctatctatacttaactgaacaacaagagcgcgtcgctgaattagcccactggtgtattcaacaagtcgacgctgggaggacccatgagaaaaaataataaccaaccattcaaacaaaaaaacaacgaattcaatagtcgtcggacggccaataattcggcaaagccaacgcgccgtccagttaacaagaaaccagcagcacccgtagaagaagcagctgttgaagaacaaactgatttcgtcatcggaaaacacgcttctttagaaacattaaagaccagtgatgcgaagaaaatcaataaaattttcttacaagatggcttgaaggctgactttgtacacgatgttgtgaaattagcgaaagaaaaacgcctaatcattcaaaatgtgcctaagaacaagttggacttattgagtgaccgtcaaaatcaccaagggattatcttagcaatcgcaccgtttgaatatgcgagtgttgatgatattttcgctaaggccaaagcccgagaagaagaaccgtttatcttaatcttggataacttggaagatccccacaacttgggttcaatcatgcgaacggctgatgcagttggtgtgcatgggattatcattccgaaacaccgtgcggttggattaacatcaacagttgctaagacgtcgactggtgcgatcgaacatatcccagtggcgcgtgtcacaaacttaacacaagaaattaagaaattgaaggatcgtgatctttggatttttggcaccgatatggctggtaccgactatcgtaagtgggatgctaaaggaccaatcggcttaatcattggtaatgaaggcaaggggctttcaccaattgttaaaaaagaagttgatcaaacgttgacgattccaatggtcggtcatgtgcaaagtttaaatgcgagtgtcgctgcgggggttttaatgtatcaggcttataatagccgtcaacctttggtatagcagatgaaaaaacagatcttaattgcagatggttataatatcattgggaactggcccgagctgaataagttgaaacaaaatgatcatctcgcggatgcgcgtgatcgcttattgcagatattatcagaatatcgcaagtttcgtgagattgaagtcatcttagtatttgatgcaatgtatgtgccagggattaaacaaagttatgtgcagtataatttggaagttgtcttcaccgatgaggatgaaacagcggacagttatatcgaaggcttagcgggtaaattaatgtcgccgattacgcaagtgacggtggtttcgagtgatcaagctgagcagtggacgattttttcacggggcgcattgcgggtgtcttcgcacgatttttatcgtgagattcgccgaacgcaccgtgaaattgaccatgatgccaagcattatcatgatcggaccttgcaacggaatatgccgtggaatccggcgcaactagatcaacttgcacaggtgcgagatgcactaagtgctgaaaaagatgattaaacaaacgttctcttaataaatgtacgataacttgttaagataaaggcgtggggttgcgtgagaggtggttcattgatggaattagcaaaacgtgatgcaaacttaattcaagcggtggttgaaaacgattctgaggcgttggatgttttatttaaagcctacctaccaatggtttatcgcacctttactccatattatattcgcttatttgatgaggacgattggttacaagaagcgcgaatcgtctgttatgagacttgccagtgttatgatcaaaattgcggcaaaagttttggtggtttttataaattacgctttcaccaccacgtattaaacttgattcgcaaagaacttgctcagaaacgacgggtcgatcagcaagccctgttatttgattgttgtccggaatgcaatgcgctcgctgaagataccgtggcatactatcagtcaacggttgaaatgcgggcgtacttagagacactatctgctttagagttagtggcctttcgggttttgacggggcaactagcagttgagcaagcgtgtagccagctagattgcacgtttgaacagatgaaacgggcacaatcgcgttgccagacaaaattaaaacgattctatactaaacaataaaatagctaaaagctgctaaccgacgatttttaggcattggttagcagttttttgtggttagtagggagcataaaaaatacttttcatgcgataaaataacaggtgacaggttaatgattgggataggtcaacaaaatgggcggcttatatatttttaaataacattaattgacattaagaaagaaagcgcttatactaaaaacatagaggaaatgaaaacgctttttataagccttttatcgctttctaaccaattaaaatttaaggggtaattcattatggcagaaaaaacaatcatgttatgttgtgcagcagggatgtcaacaagtttattagtttcaaagatgcaaaaggccgctgaagcacaaggtttagacgcagaaatttttgcaactggcgcttcagatgcagacaaccaactcgaatctaaaaaaattgactgcgtactattaggccctcaagttcgtttcatggaaggtcaatttaaagaaaaattggtaccaaaaggaatcggtgttgaagtaattgatatgaaggcttacggcatgatggacggcgaaactgtcttgaaacaagcgttagcattaatcggttaaaaaaagattaagaaaagcggtagcgacctgtttttaggcggctaccgctttttttgtttatgaatcaggtataattaaggcaatcaagtataaaggagtttattcaatgagtttaattggtacattaatttggtggctattcgggggattagtagaggcaatcggttggtttattctggggattgcctggagtattacgattattggaattccagtcgggctacaatgttttaagattggcgcattgaccttgatgccatttaacgcaaccgttgtttcaacggggggtgcaggttcgtttttattaaacatcgtttggtttttcttaggtggtcttgtgatgtgggcgagccatgtcttttgggggctattattatcaattacgattattgggattccatttggccggcaacactttaagctagcggcgttatcgttaagtccgttcggcaaacaaattaattaaaatgcaaaagggtagcgatattgatcgctacccttttttatgtggtgcaggcatatttctgtgcttagctacacaagtcaaacgattgcttgtagcaagcattcgccttgttaggctgatgctcgcagcataaccggcttttgacgcactctattgtgttagttcttctagtgccatcgcttgttcttcccagtctgattctgtttgagcgagttcagcttggactttttctaggtcttgttgtagttcttgaagcatgaggggtttagtaattacgtctgcttgggtcatttgttcttggattgcgttggccttagtctctagtgcggccattttttcttctaaagcagtaacttcgcgttctagtttccgttgtgcacgttggttttccttacttgctttgtagtcatcttgtgcattggcacttggttggataattgcactgttttggctagctgcttctgcgtaagctgcttcttcagctttcttggcgaggtagtaatcgtaatcaccgaggtatcgtttgctgccagtatctgatagttcgataatgccagtggcgacttgattgatgaaataccggtcatgggaaatgaagaggacggtgccatcgaattcacggagggctttttccaagacttccttgctatcaatgtccaaatggttcgttggttcatccatgattaagaaattgtcatggttcatcgcgagtttcgtcaagagtaagcgggctttttcaccaccactgagttgtgacacaacctttaaaacatcgtcaccggtgaataagaaactaccaagtagtgtgcgaatttccttttcaggtgttgtatagtgttcatcccataattcgttgaggacggttttgttagtgtgtaaattgcgttgctcttgatcgtagtagccgattgaaacgttactaccgactttttcatggcctttgatgaacggaatttggtgcaagatacttttgagaagggtcgatttaccaattccgttaggtccgatgatggctaagcgttcgtggcggttcacttcaaaattgattggttgtaccatgattttatcgggggaatagccgacagcggcatcgcttacttgcaatacttcgttaccgcttggatgttcgctttcgaaatgaaaatgaattttaccggcttcgttttgcggccggtctaatttatccatcttttcgagttgacggcggcgactttgggcttgtttcgtggtacttgcgcgcactaagtttttatcaacaaaggtctgaagtttatcgatttcagcttgttgtttttcataagccttccattcgagtgagaggttagcttcttttaaacttaagaaatggctgtaattaccggtataatgggtcaatgtgtggcgactcatgtcgtagacttctttagtgattttatctaagaagtaccggtcatgcgagacggtgagcaaggcaccgggataagtttgtaaataattttccaaccatgttagtgtttcgatatctaaatggttcgttggttcgtccaaaataaggacgtcttttttctcaagcaataacttagcaagtgcgagtcgcgagcgttcgccccccgatagcgtactgattggcttttcaaaggtgtcttctggaaattggaaaccatgtaagacgccacggatttcggcttcatagccgtaaccattagcttcagagaaatcgtgttgggcttggtcatagcgttttagtaaggctgcatattcttcgctagcatggtcaatggttgtgtccgcaattgcggtttcgagttcatgcatttgggcttccatttggcggagatcatcgaaaatggttaacatctctgcatagattgtccgggttgagtctaagccactatcttgcgctaagtaaccgacttgaacatttttgctaagaatgatttggccttcatcaggcgttgtgatgccggcaatcatttttaataaggttgatttaccagccccatttggaccaacgagggcaacacgggcgcggtcttgtacttcgagttgtgcgtttttgaaaaggtaatcgccgccaaaactgcgtgcgacttgttgaacttgtaataatatcacggctaaaaatcctttcgtgcggtgttttttaaagttaatcgcgttcatttttataatactactgtcaactatcataacagatttaaacgatggacagtcaaaattgtaaatatattgcttttcacaagaaaattcagtatgatttcagtatggtactacactattttcacaagcaaatcaaaaaggaggtttcaaatggttgagaataacatcccaagagcaactgcaaaacgattgcctttatattaccgctatttaaactttttgaacaattcagggaaaactaaaatttcctctactgaattatccgaagcagttaaagtagatagtgcgacaattcgtcgtgatttttcatatttcggtgcactgggcaaacgtggttatggctatgatgtcgcttcgttgctagattttttcaagaagaccttgaaccaagatcgattgacaaacgttgcattgattggggtggggaatttaggccacgccttattgaactacaactttaagcaaaccaataatattcggattagcgcagcatttgatgttaaacccgaaatgattggaacaattcaaaccggtgttcctgtctattcaatggacgagatggccgaacaattgaagaaccaacagattgagattgtcattttaacagtgccaattgatgaagctcaagaagtcaccgatgaattagtggctgctgggattaaagggattatgaactttacgccaattcggatttctgtgccatcgaacgtgcggattcaaaatgttgatttggctaaagagctacaaactttgatttacttcctcgataattatactggtgaacaaaatcaagaataaaaatagcgtttaaacaagttgctcgcagtagccgcctgtttgaacgctttttttaacgattgagatacagtaaagtaacgatcaggttcatcccagcatggctgatgattgtggtgaaaatcgaacctgtcttgcggtacagccaacataggaaaagaccgatggccgtgtagattaacaaatgcccgtcctgatgtaaaaaagcaaatagtaaactcgaaatgacggctgccaaaatcaaatttaaacgactggccaaaccgccgaagaccgctttacggaatgtaatttcttccataatcggtgcggcgatggtcgttgctaaaataagaaacggttgttgttgcatcgtggtcaccagtgaaatggtgttgagcgatttggcagtgatgcggagaatgttttgttcaatgaagccggcgataatctggattactaagaccagtacaatgccacacaatccccaaatgataatgggtttgagtgggaaaggctgctgctcaatggcattggcttgtgtgcgttgattaagatagagtaaccaggcggcaccgaggcaatcaacaatggttgtgattagaaaaaacgaggcagatagatgaccaaaacggacgactgcactaggaatcaataaaatgaacaaatagctaatgataattgaaaaattttgtttgtatagcgtcatgtgaaagctcctcaaaggttgttgtgacaatagcttagcgcattagcactcaaattgcaaaagtgctagcataatacttgcaatgttctgaaaaaatgctatgataaaaattgtgattagcacttgagatgatagagtgctaaaaaagtaaaattgatggagggattttaagtgttaaaaccattagaagatcgcgtgattgtcgccgttaaagacgaagaagaacaaacagtaggtgggattgttttggcaagtaatgctaaacaaaaaccacaaaccggcaaagtagtcgcagttggtaccggcacattaacaagtgacggcaaacgaattccacttgatattaaagaaaatgatgaagttatttacgataaatatgcaggttcagaagttgaatatgaaggtcaacaatatttagtgctccatgctaaagatattatggctattgttgaataataataaacaaaaaaattttttgaggtgaataaattatggcaaaagaacttaaattttcagaagacgcacgttcaaaaatgttggcaggggttgaccaattagccaatacagtgaaaacaacattaggaccaaaaggccggaacgttgttttggaaaaagcttacggttcaccagaaattactaatgatggtgtgacaatcgctaaagcaatcgaattagaagatcattttgaaaatatgggtgctaagttagtttctgaagtggcttcaaaaacgaatgacatcgctggtgatgggacaactactgctactgttttagctcaagcaattattcgtgaagggatgaagaacgtcacagccggcgctaacccagttgggattcgtcgtgggattgaattagcaactaaagaagctgttaagaagttacacgaaatttcacacaaagtcgaaagtaaagatgccattgcccaagtggctgctgtttcatcagctaacgaagaaactggtcgtttaattgctgatgcaatggaaaaagtgggcaacgatggggtcatcacagttgaagaatcaaaagggattgatactgaattaagcgttgttgaagggatgcaattcgatcgtggttacttgtcacaatacatggtaacggataacgataagatggaagctgacctagataacccatatatcttaattacagataaaaagatttcaaatattcaagatgttttaccgcttttacaatcaatcgtgcaagaaggtaaagccttgttaatcatcgctgatgatgttgatggcgaagcattaccaacacttgtcttgaacaagattcgtgggacattcaacgtggttgctgtaaaagcccctggttttggtgatcgtcgtaaggaacaattagaagacatcgccacattaacaggtgccacagtgattacaagtgacctcggtctagaattgaaagaaacaactatcgatcaattagggacagctggtaaggtaactgttacaaaagatgatacaacaatcgttgaaggcgctggtagcaaagatgccatcgctgaacgggttgaaaacatcaagaaacaaattgctgaaacaacatcagactttgaccgtgaaaaattacaagaacgcttggctaaattagctggtggcgttgcagtgattaaagtcggtgctgccacagaaacagaattgaaagaacaaaaatatcgcattgaagatgctttgaacgcaacgcgtgcagctgttgaagaaggctacgttgccggcggtgggacagcattaatcgatgtgatcgaaagtgttgctgcgcttaaagaagaaggcgacgttcaaaccgggattaacattgtgcttcgtgcattggaagaacctgttcgtcaaatcgcaaccaacgctggtcttgaaggctcagtaattgttgaaaaagttaaatcacaaccagttgaagtcggctacaatgcagccaacggcaactgggaaaatatgattgaagccggcatcttagatccaactaaggtgacacgttcagcattacaaaatgcagctagtgtggctgccttaatgttaacaactgaagcagtggttgctgacaaaccagaagacaacccagcaccagcagcaggcatggacccatcagcaatgggcggtatgatgtaaagaagtgcgtttgaaacgggttggttctgagcattaacctaaaaacgagcgttatggcggtttttgccataacgctcattttgtagttaagcgtaagaatcagtttcgaaaagcacgatcaataaaagaagtgcgactcgaggagcacgttaaaaaatgagtgtgttcaaaccgggatgttctgaggattaacggtgaaatgggcattatggcggttcttgccgtaatgcccattttgcagttaagcggaagtcggtataaccaaaagcacgattaaacccaaagttccaaaactggcaaaagttttggaacttttttatttttcaaaaaagtgcgcatacataaattgtgcgcaaccctattaattaattttgattgcggtataataatagttggaggcgttgacaatgatttttcgaaaccggcggatactgataagtaccgaatatcttatgaataacaaatagcaataaaaagacacactcccaaactttggccggtctggagtgtgtctagaaaaaaggtacgcattagcgcacgctatttgtgtaccctattttaccataaataggagtgatttaaatgtttgaatataaaaagaaccctgcaattagggaatacgaaacaaaaaaaggcgtcaaaaagtatatgttccaaatttatacaggtattaatccagcgactaacaagaaaacgacaactacccgccgcggtttcaaaacgcctgccctggctaacgcggcatatcgcaagattgaagccgaagtgatgaataacaagtacgagtttagcgtcccacttgaatccgacgccctcacgttcaacgatgtttatcagcgatggtttaccgactcataccgcaaaacagtccaatccagtacagtctacaagacaaagcaaatctttgattgccatattttgccggacattggcgcaatgaacatggatgatattacaccggaggtcttgcagccaatcgtaaaccgttgggcgactaagtacgctaaactgaacatcgtgagtcgctatgccaatcgagtgtttaagtatgcctatacgatcaaactgattaaaagcaatccgtttaatcacgtattattaccagaacgacaagtcaataacacaaacaagacgcccagcacgaacttctttagcgctgacgagttagataagtttactcgttttctggttaagggacgcgcaaacggtaccgtgagcatgatgcacgccgtgtacttcatcacgatggcttacacgggattgcgtaaaggcgagttattggcgcttgagtggtctgacattgatctagaggacaataagcttgatgtaaataaaactctagcaatggatgagtttggtaagctggcaacccagccgcctaagtggttatcttatcgaacaatagacattaacaaccttgtagctaatacgttgcaagaatataaagaatttagtcactctaatctagtattcccaagtgaaaaagacacctggttgaaccttggcaagcctaacaactggttagacagcattatagatcaaggtgccgaaacgtttaaaactactttccaactgactggtgatgactattataaaacgtttgtgcatcgtattaccccgcatggtttacgccatacgcacgccacatggctgtttgagaaggataatacgattacacccaaagcagtccaagagcgcttaggccacaagaatattagtgtgacaatggacatctatacccacgttacttcaaaccaaaaggacaaactaaagtctgcattagacatcgactattgagggttagtcaaaaagttagtcaaaaaaggtagcttatccgttggggctgtaaggattagcgaaaattaacttaaaaacaccatttctagcacacctcaaatcaaaattgactaacctttttgactaacctttgatggcaaatatgggcaaatatagtaaatccgaaaacaataaaaaatagcctaatcactgatttaacagcaattaggctaatatcgtaaagtataagatattcaagtaaggagagtacaggatttgaacctgcgcgccggtataagccggttcgacggatttcgagtccgttgcattaccactctgccaactctccagaacgttattcattataacagacttctaaagaactgaacagcgtaaaacgcaaaaaaacctacgtgcgcccacattctattcgatcaccaccatcccatcttgatcaaattgccagtcctttgagtaagcgacttcccaatagtaaccatcgggatcactgaaataaccactatagccaccccactcgccccattctggcgctttgatgagcgtggccccgttagcgagagctgttttaaatgttgcatcgacttccgcttgactatgcgtattaaaggcatgggtcacgccgttgaacgttcttggaaatggatgattatctgcggataagccaatatcggctagtagtgcagtgtacggaaacaattccaacttggtcccagtattattgaaaaagacgattgtctcagcattttctaaattcggcgcttgaaagccgagtgcttggtaaaactgacgtgacacggttaaatcctgaacacctaaacaaattaaatggatactattcatcaaatcacctactcgttttaaattaacctgattgtatcaatccgaagctaataacgcaatttcccccgttaattgaccaattattaaatttattgaatcatatttctttttataaaaaaattcgttatacttaaagaatcttaaatgatagaggtttattaatatgaagatttcttatcgcaaactaccgtttttattcaacttaattttcttagttgtaacggttttacaatctttgatcattctagtggttaacccccacgttacgaaattcatccccacttatatggatgccatggcgaaagtatggtggttgtgcattattgctattattttgcatattgttgcttatttattatcactcgatcagaatttgattttactggcatacttatgtgcaatcgtcgcttacatcatcttgattttagtccctaatttattactagttgcccttttcttgttagtggttagcttgatcatttcatttaaagtctatcatttccattatcgaacacctgcttagtcctcgtcggagggctatttttttatgcgctaacccatttaatttatggtataattagtttgaaattaagacaaaagaggttctagtaatgaaacgactaactgcgattctatctttattggtactttgtttactgccttttgtaagcccttacttattcggcaaaggcatgcgcttttctagtaatcatcaaaaaaatccaatccgctttgaagtttgtcggcatccaaaggtccaccacgcagtcgatcgtgatggcagtgaacaaaaattaaacgccttcaaccaccgctgcgaacggttctttaatcaactcacacttgcgcttgaagcattctacgccgtagctggatttcttggatttaccgtctttattctattattagaaccactacttgcactcctaatgaccctcaagaaagtgccacaacccaaaaaggcacaatcccatactccgcagaagcatcagattgcgccttataagtggcatttattagattagtttaagttcaacttttgataagtataatggccctcttttagtgattgattcgcatatggcgtctcattgagcaacgccacatattcttgggcccgttgttccgaactaaacgcccggatcattttacttttatcataataaagtgggtttgcttgatataaaacaacgtagatccattgattcatctgtcatcacctaactttgtaatccacataaagaaagaccaactcgtaatgagtcggccttttttaatgtcatcttaacgacgagcttctttgatacgagctgccttaccacgtaatgcgcgtaagtagtataacttagcacgacgtacacggccatgacgagtaacttcgatttgagcaacacgtggtgagtgtaatgggaaagttctttccacacccacaccgctactgattttacgaactgtgtaagtttcactcacgccaacaccatgacgtttgataacaacaccttcgaataattggatacgttcgcgagtaccttcgacaacacgcacgtgaacacgtacgttgtccccaggacggaagtcaggaatatctgaacgtaattgagacttagtaatttcttgaattaatggattcattttgaatctctcctttttccacagatattcattaacgtcttgcgccagcggaataccgttgttttgtgactaatcatcacaatttttaattttagcataattcaactgagaataaaagccttatttttcagccgcttcttgcttaatttcttgtaaccagtgcaactgatccttggtcaacgtcatcttctctagtaagtctggacgccgttcatatgtccgtttcaaggacatcttctcgtgccactcgttaatgagcttatgattcccgttcatcaagacttcaggtacctttaaaccgcggtattccggtggtcgcgtatattgtggatgttccaataagccggtcgaaaaagaatccgtaaccgctgattgttcattccccaagacgccaggtacaagccgcgaaatggcatcgatcatcaccattgcgcccaattcgcctccagtgacgacgaaatcgcccaatgagacttcatcagtgactagcgtgcgaatccgttcatcatagccttcgtaatgcccacagataaaaaccaagtggtcttcttgagcaaattcttcggcaactttttggttaaacgttaccccagctggatcgagcaaaataacccgtttgtgccccggattcttggcattcacttgatccatcgcctcaaaaatcggttgtggtcggagcaacatccccgcacctccaccatacggcgcatcatcaaccgaattgtgtttattgactgaaaaatcacggaaatccgtcacttctaaatcaattaagtcacgatcaattgccttaccgataattgattgggataacccattttgaaccatatctggaaataaacttaagacatcaatcttcattatcaatcaatccttctggtacttcaacgtaggctttacccgcttcaatatcaattttcttaacgactgacttcaaaaatggtaagagtaagtctgaacggccgcggcgcttgatcacccagacatcgttgggacctggatcgatgatttctgagactttcccatagctggtcccatcggcttcttcaaccacttctaagccgataatatcaccgtagtaaaactcatcatcttccagatcatcttcgcgttgacttgcagcaatctttaaattatggcccttgaactgttcaacatcgttgatattgcccattccttcgaactgtaatagatagaattgcttgtgttggcgcattgccgccactttaacatcaacaaggccattgggcatttcgacggccagttgcacgccttttttaaatcgtgaatccgtaaagtcagtcgtcgcaatgacccgcacttcaccacggatgccgtgggtattgacaattttaccaacttgatagtatttttctggcatttaatttctccttaatcgacaaaaaacgcctaaataaaacatctctgcttcatttaaacgtttttgttaggcatctacaatatttaaacggacccgtttttggtatggtgctttcacactatagacaatggtacggatggactgtgcaacccgtccctgcttgccaatgacgcgaccgatatcacttggattaacctgtaagtcaaattccataaaacgttctgtctcatgttcagtcaatttgacgtcttccggatgttcgacaagtggctgaacaattgcaataattagttccttcacgtctgtcataacgaatccctactttttagcgaagcgtgcttcgtgatatttttgcataatcccttgttttgataaaagattacgaacagtatcagaaggttgtgcgcctttttgtaaccaatccatgataacttcttcttctaacttcaagtcaactggttctgttaatggattgtagtaacctacttgttggataaagcgaccatcacgtggtgaacgtgaatctgcaacaacgatacggtagaatgggcgtttctttgaacccatacgtttcatacgaattttaactgacattaatgccacctcctattaattctttaacatgtcataatataccaaatttcaaacgccgtgtaaagtgttttttctttacaggacaaatttttttaagatttaaaacgacgcgcgtttttgagacgtttcttcttgtttttcttttgttttttcatcattgaattcatggccatcttacccattttacccttgataccgttgcccattaaaccttccatgccgttaaagttgccctttgacatttggttcatcatctttttcgattgattgaattgtttgatcatccggttaacttcaacgattgggcgaccagcaccagccgctaaacgacgacggcgactaggattcaataagtcaggattttcccgttcttgtggcgtcattgattgaacgatggccttcatatgcgccatgtctttcggatccatcttgatgttcttgagttgtgggttattggccatccctggaatcatcttcatgatatcttccaaaggtcccatgctctgcaattgatccatctgatccaagaaatcgttaaaatcaaagctattttctttgatcttttcagccatatcagctgctttttgctcgtcataatcttgttgcgctttttcaatcaagctcaacatgtcacccatcccaaggattcggctactcatccgatctggatagaaaatgtcgagttgatcaagtttttcaccttgaccagtgaacttaattggtttgccggtgactgcacgaattgagagggctgccccaccacgtgtgtcgccatctaacttggttagaacgaccccggtgacatctaaacgactgttaaagccttcagcaacatcgacagcggcttgcccagtcatggcatcgaccgttaagaggatttcatttggatgggctagctcattaatatcagccaattcttgcatcaaggcttcgtcaatttgtaaacgaccagccgtatcaattaagacgtaatcgttcttttgtaaggccgcttgtgctaacccttgacggacgatttcaactgggttgacatccgtccccatttcaaagacttgtgcgtcaacttgcttgccgacggtcttcaattgttcaatcgcagctggccgataaacatcggcggcaatcatcaatggccgtgctttttcgttttggattaaatattttgctaatttcccggccgtggttgttttcccggccccttgtaacccaaccatcataatgattgttggaatatgtggtgattcattcaacggcacagccgtttcacccatcatcttcgttaattcttcatcaacgatttttacaatttgttgtgcaggtgataagctatcaaggacttctgccccgatggcgcgttccttgacgactttaataaagtctttaactactttaaagttaacgtcggcttctaataatgccagccgaatttcgcgcatcgcttgattgacgtctgtttcggtaatcttccctttacgccgaagcttactcaatgcgccttgtagtcgttctgttagcccttcaaatgccattttttatcagtcctttaagttaattattgttcggttaaattcagtaagtcagccaacaagcgcatcagttcttgatcgtctggatagtgcgcttgaatatacttttgtagcgtatctgcactggcattttgctgttcataattacggtaaagatgtagcttttcttcgtaaccctctaagattttttcagtccggcgaatgttgtcatagaccgcttgccgactaacattgtattcagcagcaatttcaccgagggaaaaatcatccccataatataaagagatataactatgttgttttgccgttaaaagtgcgccataaaattcgaacaacgaattcatgcgtgcgttttgtgcgagttccatttgacgcctcctagacttagtttgacctaagtattagagtaccgattttaacgggcttagtcaacgttttattgcgcgatttaactagaagtttgtgcattaattatcttttcactggtataaacgaaaaatcatgctaaaatagaactgtaagctttttcataacttaaattggaatttctatggaggttgtatgatggcagcaacaattatctattggggcgttacattcgcattaatcggttgggggatttggaacttaatcttctcagtcgtctatttaaagaacaaggaaaatggtaatctttggttcttcgccattttaaacaccttaaccttattattcgggctattattcgggtgggtcttcaataatcacgcttggcaagaatactggttggttaaagcaaccgcaaccaacagtctactaggtggcgttttaatcgcctatgtcgtcttaattatcgcccaagtgattttgggacgcgaaccaaaaatcaaaacagcttaatgctaaaaaagaggatcgacacgtttgtcggtcctcttttctaatgttgtttagcgattaatcgcgcgatattttcactgacttgcgttaaattaacttcagtagcttcaattgcttttgctaatgacattgcgccaggtgttgtgcagaaaatactgtcaattcctaattcataaagcacatcaatccccgctccaatatatccggcaatcgcaatcaccgtcgcctgtggattaacttgtttaaccgctttggcgactccaattggcgtcttaccatattgtgtctgaaaatcgattccgccctccccagtgacgacgatatccgcatctcggacaatctcagttaacccagtttgcgccacgaccatctcaacaccaggttgaacctgcgcatccgtaaacgccaataaaccagcccctaagccaccagcagcacccgcacctggtatttgcgcaacagatttccctaaatcacgttcaatcaccgcagcaaagtgcgttaaattccgatcaagttgcgcgaccattgctggggttgctcctttttgtggaccaaacacggctgatgcgccattcgggccgaaaagcggatttgtgacatctgatgcaatcacaactttgacccttgatagtgccggtatcatatgcgtcgtatctatccgtgctaaacgcgcaagcgccccaccgcccagtggtaacacctgtccgtcaacgtctaacaaacgcaccccaagtgcttgtgccattccagcaccgccatcattggtcgcactgccgcccaaaccaatcacaattgtttgcacaccttgtgctagtgcggctgccatcaactgaccggtgccataagtcgttgttatcaacggattttgcgtttgcgcatcaatatactgaatcccactagcggctgccatctcgatcaccgccgttttgccatcacccaagatgccatattgtgctgataccgtttggtccaatggattttgcacttgtgcggttaagaaccggccattggtcgcatcgacaagcgcttggacagtcccttcgccgccatctgccattggcacttcgacataggacgcgcttggtaggcttttttcgaatcctttccgcattgcacgagccgcttcttttgcggtaacagcatttttaaatgaatctggtgctaacacaattttcatctgttaatctctctttcttctaaaaaaggctagaacaaattatttgtcctagcctttttgctatttaatcgcttgactgacgtctgtatcagttgttttttgtggcccatcaccgacaataatgtccttgaataagccataaacaaagcggtttggatcaaagagttgtaagtcgttcatttgttcacctagaccaaccatcttcactggtaagtgtaattctgtgcgaacggctaaaacaatcccacccttggccgaaccatctagcttggttaagacaatcccagtcacatcggttgtttgcttgaattgtttagcttggactaaagcattttgtccggttgttgcatctaagaccaacaacacttcttgcggtgcagctggcacttcacgcgtgatgatgcgtttcactttttccaattccttcatcaagttgacgttgttttgcaaacgaccggccgtatcaactaataaaatatcgaattgttcttctttagcgcgtttaaccgcgtcatagacaactgacgctggatcactccccgctgcactagcaaccacggggacattatcccgacgaccccattcttgtaattgttcgatggcgcccgctctaaaggtatcaccagccgctaataagaccttcttacccgctttttctaattggtgggcaaacttcccaattgaggttgttttccccgcgccgttgacgccaacgaataagaagacagttaattcgccttgtggggcaaaatgcaattgattatcttctgcttggccttcttgaccgtacaaatcaactagcttttcaacaatcgcttgtgaaaccgcttctggtttcttaacgttacgcaacttcacttcgtcacgtaattcgtcagcaatcttcatcgctgtttcgtagccaacatcggcttcaattaacatttcttcaacatcatcgaaaaaggcttcatcaacacttctaaagttagcgaacaacgcatttaagcgttgcccaaatgtgagccgggatttttctaatccatcatcatacttcttcgtttcagcagcttgcatgtcgccagttactgcttctgtttccggcacttcttcaatcgcatcggattcttcagttactgccgacgcttcaactggttctggttctggttctggttctggttctggttctggttctgagtttacgggtgccgccgttggtgtgtcaagcggtgataccgtttctgaatcatcttcagttgctaaactggctggttcatcggtttcagttttctcagctgccgcagtttctgcaggggtttgcgattcaaccggcgtagcgtctgattcaaccggtgtttccggtatcgcttggtcttgttcaaccggtgtttctttttctggttcggctgagaatgcttttttaatacgatcaaataatcccatggttttcctcctaggctgttgcgtgttcttctaatgaaacggaaacaatcttcgagattccagattccgccattgtcaccccgtataagcgattggcttgggtcatcgtcccttttctgtgggtaatcacgatgaattgtgtatcactctcataacgtttcatgaaacgaccgaaacgatcaacgttggcttcgtccaacgaagcttcgacttcgtccaaaatacaaaacggcactgggcgtacttttaagatggcaaacaataacgtaatcgccgtcaatgcgcgttcaccaccagataaaagactcaagcgttgtagtttcttaccaggtggttgcgcaataatgtcaatcccactcgttaatagtgcgcttggatccgtaaacgttaagctggcatggccgccaccaaacatgatcgggaagatggtttcaaaagcagcggcagtttgttcaaacgtttccttaaaccgcttttcaacttccgtatccatttcagccatcgatgctaataattggcgcttagcgtccatcaagtcggcatcttgttgcatcaagaaatcgtaacgttctttaacgcgttgataatcatcaatggccgccaagttgaccgttcctaaatcagctaagccgagtttcaataatttcaacttagaccgcaattgatcgtcggttaagtctgatgcggccaaagcggccttggcggcttcgtaagtcaattggtaatcttcgctcaatgtatttaagcgttgatcaatgttaattttaacccggttgagcccgacagcattttgttcttgctcagctaaactatttttttgtaattggtagacgcgtgtggcattggcttgaagcgtttgttgttccgccttcagcgtttctttttgcgcgcgttcagtggctaacttcgcttggactttctcaatcaaagcattggttgcctttagcagtgctcgtcgttctttttgactcgaagcgtcttcttgatccgcttgttttagcgcagctagtttatcctgactggccttcaactgggctgccaggtcgttgctattgcgagtagcaaccgttaatttctcctgaacattcttttgttcagcttgagcgacagccaacttggtttcgagggctgtttgttgttgcgcaatttgtttttgactctcatcaaaatgttgtaattgctcattagctgtttcgagatctgcttgcagctgtgcaatcgacgcaacaatttcagcttcggctgccactaattctgcctggcgttttaaatctgcctcataagcttgttgttgttgttgcacttgataatcggttgcttgttgttgccgttcaaactgactcaaacgttcgtcagtcaaggctaacgtattttgggcagcttgatattgattcttagcggtttccaatgccgcttgtttcgtatttaattctgcttggcgtgccgttaattgagcttttgcggcttggacactggcttgcttttgatccaaagcgacctgcatcttggcaatttgaccttctaaatcagtcaaggtttgcttacgcgcaagtagcccaccattgttttgtcggttattatggcccccagtcatcgaaccacccgggcttaaaatatcccctgctaacgtaatgattcggtaacgatgccccgtcaattgactcaatttaatcgccggctccaactcagtcgcgacaatcaaattgcccatcaaatggttcatcaccggtcgcacttgttcatcaaactgcacaagctcactggcaattccgataaatccaggctgctgttgtaattggtgaactaagctacttggtagtaaacgtggtttgacaacgttattgggtaagaaagttgcccgcccaatccgattggttttcaaatactcaatcgcttgtttggccgtctgttcatcccgtgtcacaacttgttgtagctgtgcgcctaatgctaattcaatcgcttgttgatactcactgggcacttgcatcaattccgctacagcccctaataaaccagggaactgttgtttttgcttcaagacagccttaaccccttgataaaagccggcgtagtcatcatttaattccgcaagactagcttgttttgctttcgctttttgtaaaataccagacgcttggaaccaactattttgttgattttggtaagccgcttggtccgtgttaatttgcgtttgtaattcggccaactcattggacaacgtttcgtattgcgctttgagtgtttcaagttgggctttttgggccgcttgttctgcctttttttgtgccaattgcgtcgatgtctcatcgactgcactatcttgccgtgcaagttgcgttttagtttgtaacaagttcttttctaaatattgttgttcattatgattggtcgtttgggcttgcatctgatcgatgtattcttgacgaatttgttcaatcttcgctttcagttccgcttcactaccagacgcttggcgtttaagggtggttaactccgtcttcaacgccctcaatgccgtcactttttcttcataacttgcctttaattcagattgattggcttgttccgccgttaattgctgttttaatgtgtcgatctgttcgactaaactttggcggttcgcatccgtataattagcgcgctcttttgaaacgttctcttggcctaatagattttcagccaagcgagacttttctaacaacgtctgattatcttgttctatttgttgttccaactgggctaaggttgcctgattctcggtttgggcagccgtcgtcttagcgatgtccgcttcaatctcttgcaacgcttgcgcaagggtttgcgccttttctttgtacgtcttttgatcagccactaattgatcaatttcaatcaccaataattgttggtgcaatgcatcatattgcgctttttgatccaagtaatcctgcgcaatactgctttgttccttcaacggttcaacttgtccccgtagttcatgaagaatgtcggtgacccgactcaaattttcatctgtttgatctaattcagattgagcctttttcttttgttgtttatatttcaaaacaccggccgcttcttcaataatattccgccgatcttctggtttactgttgaaaattgcttcaacccgaccttgcgaaataatcgaaaaagattctcgcccaaggccagaatccataaataaattaacgatgtcttttaaccgacaactcttttgattcaaataaaactcactatcgccatttctaaataaacgccgcgtaatcgtgacgttggcttgttcttgtttcaaatattgatcgctgttatcaaaagccagcgtcacttctgccttattcatctgtggtcgaatatcagtcccggcaaaaatgatgtcgggcatcttttcgccccgtaagctcttggctgattgttcgcccatcgcccaccgaattgcttctgtgacgttacttttaccgctcccgtttggtccaacgatgcccgttaaaccttctgaaaaattgatttctgttttatcagcaaatgatttaaaccctgataaaaccaatgactttaactgcatgcactaaactccctacacacggcggttggtttcaactgtcgtttgcttctttctttatttcagtttggcaagcgccactttagcagctgcttgttcggctgcttttttgttccggccaacacctgaacctaagacgcgatcgcccatcatcacatccacttcaaattgacgggcatgtgatggtcccacttctgccaataacttatattcaatctcaacttcaccatcttgttgcaagaactcttgcagattggtcttataatccgtttggtctgaaaattcaccggcttcaatcttgggaaagacaacttgttcgatgaatttaacaactgcgccacgcccttgatctaagaacaaagcgccgttaaaagcttcaaataaatcttccaaaagtgttgctcgtgcccgcgcaccgtttttttcttcccctttaccaaggcgaatgtatcgatcaaagtgcgcttctttggcaaaactactgaaactcttcgtgcagacgattgccgcccgtaagcgtgtcagtttgccttctggccagtccggatattttttatataagtattccgaaaccgtaatttccatcaccgcgtcacccaagaattcgagccgttcgttatcacgaagacccaactcccggtgttcattgacgtatgacgaatgtgtaaaggcttcgtccaatagtgctaaattctgaaattcaatgccgtagcgggctcgaagctcgctcactagtgctgcatccaaaattaaattaccccatttcaactgtttaatctttcactattataccgtttatacgcttaaaaaaacagcgtcgttcctagcaaaccgtttcttttattaatcactaaaaaacgcctgttttgaagtattcattgtaacacgcaaacgaatatttcaaaacaggcgttgctttatgcagatggcgttgtcattgctgctaaagcggtttgataactcgctagttcagcttcagttgcatagacatagtgttcatcggccacttcgcgcaattgacgaccttcattatctgcctcaattgaactatcataagcaattcgccgacgttgccgctcgacctttggatcaggtaacggcacagcagacaatagactttgcgtatatggatgcaatggtcgatcataaatgtcatcggctgatgccaattccataattttaccgtcatgcatcaccgcaatccgatcactaatgtatttcaccatcgataaatcatgtgcgatgaataaatacgtcaagttttgctgttcttgaatttctttcatcaagttaaccacttgtgcttgaatcgatacgtcaagcgccgaaatcggttcatccgcaatgataaatttaggttttaccgcaagcgcgcgggcaatcccaatacgttggcgttgcccaccggagaattcatatggataacgcgttgcatggtctttattcaaaccaactaattccaaaagctcgttgacgcgtgcatcacattctgcatcatttttaaccaaatgatggatatgcaagccctcagcgatgatatctttgactttcatccgtggattcaatgacgcgtagggatcttggaaaatcatctgaatctctttccggaacgccttcatttcacgactatgatttttaatcttactaatgtcacggccatcgaatagaatttcaccatctgtcgggttgtatagccggatgatactccgcccagttgtactcttcccagaaccagattcacccaccaagccaaacgtttcgccttcatagatttcaaatgagacatcatcaatggctttgacttcggatttttttccttggctaaaatattgctttaaatgtttaaccgacactaatacttttttatccttgtccatcaattgtccctactttctcttgaacttgtgtcgcctggtacttagccatcattgcacggacggctgctggtggttccacagctggtgcatctggatgcaacaaccaagttgccgcaaaatgcgttttcgacacttggaaaaatggcggttcctgttccacatcaatttgtaaagcatatggattacgcggtgcgaaggcatcccctttcggtggatccaacaagtctggtggggtccctggaatggcttcaagacggccagaagtatcaagtgttggcattgagttcaataagccccacgtatatggatgcttgggttgataaaaaatttcatcaaccaacccatattcgataatcttaccggcatacattaccgctacgcgatcggcaatccctgccacaacacctaaatcatgcgtaatgaaaataattgaggtttcaatcttgcgttgcaattccttcatcaaatcgataatttgtgcttgcactgtcacatcaagcgccgttgtcggttcgtcggcaatcaggatttgtggataatcaacaatcgcaatcgcaatcacgattcgttgccgttgcccaccagaaaattgatgcggataatctttcatccgtgctttggcattcggaatacccaccaactctaaaacactctgtgcacgtttcattgcttcttccttattcattgttttatgaatcaacaagggttcagcaacttgtttaccaatcggcatcgttggatccaatgacgtcatcggatcttggaaaatcatggaaatatcgctaccacgtaaggcattcatttcctgttctggtttttgtaagagatcttcattgtgatacttgattgtaccacccttaatttgagcattacccgctaacaagcccataatactacggaccgttaccgacttacctgaacctgattcaccaacaatcgctagtgtttcgccttttttcaagttgaaactgacatcgcgaatagcatggacgtcccctgcgtaggttttaaaatcgatacttaaatgtttaacttctaaaatatttgccatttgacgacctccaatgatgaaaccgcgtggaaacggccttgtattgacatgctttttgaaactgactctgcttctaaacgtgctttcattaactgctttctgtggttagctacgtctaataaataatcaacaagttgattattcgtcagactatgctaatccgcgaaagctaaccgcctacttgcacacgctatgattttggatcgaatgcgtctcttagtccgtctgctagtaagttgacggcaatcatgatcacacagaggactgctgctggataccacatttgatatggcaagaaacggaaagctttttgcccatctgataataacgtccctaatgaagcattcggtgctggaatcccaatcccgataaagctcaagaacgcttcgaagaaaatcgcactcggaattgtaaacatcgtttgaataataatcgttgaggataaattcggaatcaggtgtttccaagcaatcttggtggaactttcacccaacgtccgtgcggcgagcacgaattcttgttccttaagttggaacgtttgggcccgaatcaaccgggccattgtaatccaaccggtaaagccaatcgcgatgacgattgacaataaacctggacggagtaccaacatcatcaagacaaccacaattaagtttggaattgatgaaatgatttcagttacccgctgcatgaacatatccaaacggccaccacgccatccggaaacaatcccgtatggaatcccgattaataaatcgaccaatgtcgctagaatcccaattaataaggataagcgtgtcccgtataaaattcgtgataataaatcacgaccgagataatccgtccctaagataaacgttttgcctttgggaacgcccgcttgttgatatttatcaactttaacaccggaaacgtcaatcttaccggtaaaaccagggatattccccgatccaattttaggcggtaagttagcgtacgccacattttgtgtatttggactttgtggtgcaatcactggtgccaataaagcagccaacatcacaattaagaggacaactaacgaaaccaccgcgactttattttgctttaagcgccgaatggcatcttgcgtaaacgtcaatgatggtgcactaattttttcttgtgcttcatgcgtgtcttgtgtaaggggcttgaatgagcccgctggtattttaatatctgccatttagtgcgccccctgactgtcacttaatcgaattcgtggatcaataatcccgtaaagaatatcgacgactagaataatcactgttaataagaatgaatagaaaatggtcaagcccatgatcgttggataatcattcgtcataattgacttcacaaattgctccccaattccgggaatcgagaaaatattttcaacaactagtgacccagtcatcaagttgactgccatcggcccgataatcgtaacaaccggaatcattgaatttcgtaaggcatgctttgccactgtttgccattttgaattgcctttggctttagcaagttcgatgtaatcactgtttaaaacatcgaccatttcagtccgcatgaaccgagccgtattcgccaatggtgcaaccgctagtgctaatgttggtaagacactagatgaccagccgtcccataacgcaattgggaatagttgtaatttaaaggcaaggaaaaattggagtaagaccgccaacacaaagttcggaattgaaatcccaacgattgaaaagaacgttgcaacgccatcgacccatgtattcttgcgaatggccgccactgcccctagtaaaatacccagtaatgagccgacaatcatcgcttgtgccccgatttgtaatgaaggtcctaaacgcgtcatgattaggctcaagacgggctgattgttgaactggaaggatgtgccaaaatcaccatgcaacaagccacctagatagatgaaatattgctgaattaatggtttgttcaaaccgtactgttcattcatgatccgtaattgatcagcactcattttttcctgattcgtatatggcgtccctggcatcaacttcatcatgaagaaggtcacagaagcgacaatgaatagggttagcactaaatagaatattcgtttaacaaggtatttactcataagttcgctcctaacaaaaacgggcttcattgtttttcaacgctgaaacccatctttataaagtcagtttatttttttaaataaagtgagacattattgtagcttcctgaagggccgtagtctaaacctttaaggcttgggttagttaagtacgccacacctgattgatacagtggaatgacacctgactctgtattcataatatcttgtgctttaacaaggttttgccatcttgctttaggatcattggcgttgtcacctttacttgccttgatctgtgcatcgtattcggcattgctccaatggcccccattgttatcgccgcctgttacaaacaagtctaagaatgtgattggatctgggaaatcagcgttccaagcactaaccaccatgtcgaaatcaccgttcgttgaacgtgttaaacgagtcttaaatggcacgttcgctaatgtgactttcaaacctggtaagttcttttgtaaagtattttgcaaatattcggattgtttcttggcagtatccgtatcatcgccaagtaatgtgtaattgaatgttttgcctgtttgcccagtttcagcaaggccttcgttccaaagttttgttgcttctttagggttgtaacttgcatttttcttacccgctgcgtctaaatcatcaacaaaatccttcttagttgttgggtcaaatgacatattctttggtgtcacagaagcaattggacttgaaccatcacctagaacctgtgcgactaattctttacgattaattgtcattgaaattgctcggcgaatcttcgcatttttaaagattggattcttttcttggttgacttgcatgtagaatgttgctgatttttgtaaggttgagtaatgtggatcgtttttcatttgtttagctgtgtcaccactgatcgccgtccgatctaatttattactttggaagaggtttaaagctgttgatggatctttaaccacttgatacttcaacgtcttaaccttaactgctttcgcattccagtaattggtgtttttaacttctttccatgagctatctgggccattccaattttctaatttataagggccgttgaaaactaatgttttagaatttgtcccgtaactcttgccagctttcttgaccgcttctggatattgggggaagaatgttgaactggtcatcaattgactgaagtatggaattggtttttcaagggtgacttctaaggtgtgtttatccttagcgactacacccaatgaattaaccggttccttaccagtcgtgatgtctgctgcatttttaatgccttcatagatataagcatattgtgaaccgacctttggatcaacgactctgcgccaagcataaacgaaatcttctgccgtgaccggttgaccattgctccacttcgcgtcttttcttaatgggaatgtatatgttaaaccgttattagttggtttgaccactttagtcgcaatcgccggtttgatttctttaccctcgtagcggtaaaggccttccatcgtatcggttaaagcctgcgcaccgatcacatccgtatttaacgctgaatccattgtcgcaatgacatccccagttgcaaaactggctgtgtcagtcttaacggcttccttgctacctgagttaccacaagctgctaataataatgtgaccgccactgttgttatacctaataccaaactcttttctcgtttcatatggacactcccttcagttattaaaaataataatacatgattaaaaatgaaaagtaaataataaagattaaaatattctaatttattttcattgattcagagccattataagaatcattctaatattataacgcatccgcaaatgattattatgtgaataatctcattttcacaaactgtttaaaatgcaaaaaaataagcctgtcggtcgcgaatactcacaaccaacaggctcgttttcaaggttattatttgatttttgttttaatgtaagcaacggcatcagctaccgtaccgatcttttcagcttcttcatccggaatttcggcaccaaaagtgtcttctaattccaaaacaaattccacaatatcaattgaatcagcatccaagtcttccttgaagttcaattcgtctgttacctgatccttatttaactcaaatcgatcgccaataatagccgcaatcttatcaaagatttcttgttcattcataattaaaaacctccaaattgaaacccttacctacgtacttaacactttgggtatccagtgattatacataacttcgcaactcaattcaagtaaatcaaatcagacttgcgaagtatattgtagcgcctttggaacacattgtccacctattttaatcggtttcttttgggctattttgttggtcaaaataatcgattactttttgaatcgtttggttcgccagcattgcatgaatctggcgaacagtgtagtaaaccgtgcggccatctgcagcaccgtgcgccttaacaacaggggcttttaagcctaataaaacagccccgccataaacagatgtgtcgaatttatcacgaatcccaccaacactctttttcaagagtaaaccaccgattttttctttgacaccagcatccataatcgcatgtttgacttgcgacatcacgattgtggcagtcccttcaattgctttaagcgtcgcattgccggtaaacccatctgtgaccacgacatccgcaaccccttttaagagttcacttgcttcaacgttaccaatgaagtttaacgttagatcatctgccagtagttgatgtgctgccttatgcaactcatcacccttgccagcttcagtcccattattcaacaaaccaattcgcggcttttgaatgccacggacgtcttgtgcgtagaagttccccattaagccatattgatgcaaatgctccggctttgcttcggcgttggccccaacatctaacatattgaagcctaaatctgaattaatggctggtagggtaggcattaaacctggacgatcaatccctttaatccgaccaatcacgaataatccggctgctaagagcgcaccagtattccctagtgaaaagagtgcgtctgcttccccatctttaactgcctgcgccgccagaaccattgaagcttgctttttacgccgaatcgcacgcactggttcatcttcgctggtgattttttcggtggtatgcacaatcgttaaccgcgtcatatcatcaatcaacggtttaatttgtgcttcatcaccatacaacgtaaattcaacatttgttaattctgagcgggcttgtaacaccccttcaattactgattggggtgcaaaatcgccgcccattgcgtctactgcaattttcatcatcattcctctttccgttttcaatctaacgttaggtaattttgcttttgttgttgtaagtatgttttgagtggcgtatggtccggtgctgccaactcaggatcaagcgtgaagattttttgcacttcttgttgagcgacttgtaaactcgcaaagtcggctactggatcgccaactttaaagacgggcaatccagattgacgatcaccaaagacttcccctggcccgcgcaattctaaatccttctgcgcaacgacgaatccatcagtggtttcagtcataatcgtcatccggtcaacaccttgttggttcttcggatcagccaccagaatacagtatgcctttttcttacctcggccgacccggccccgtaattgatgtaattgcgccaacccgaaccgatccgcatcaaaaatgagcatcaccgtcgcgtttggcacatcgacaccaacttcaacgacggttgttgaaaccagtaattgaattttgttctcagaaaaagcgttcataatctgatttttttcatcatcttttaactggccatgcaacaatgcaacatggtaatcaggttcaaattgttccaccaacgttgcgtaaatctcctcggcattctttaaatccatctgttcagattcggcaatcaacggtgtaatcgcaaagacttgcgaatcgtttgcaagttgtttacggacaaagctgagggcttgttcgacttgattactacgcacccaactggtttcaattggaatccgtccttttggcaattcatcaatcgttgaaacgtccatctcgccatacgcggtaatcgccagcgtccgcggaatcggggtcgccgtcattgcaagaatatcaggctgtaaccccttttcacgcaaaattcgccgttggttgaccccgaaacgatgttgttcatcaattacagcaaagcctaacttatgatagaccactgcatcttgaatcaaggcatgggtgccaataataatattgatgcgcccggattcaatgtctgccaacaacgtccgccgttctttagccgtcgtcgaaccggtcaataagccaacagtcacgttcattggtgccaataagcgttgcaagctttgatagtgttgttccgccagaatttccgttggcaccatcaatgcggcttgataacccgcagtcactgccgcgaacagcgcaatcgccgccacaatcgttttcccagaaccaacatccccttggagaaggcgattcatatgcgctggtgattttaaatcaagacaaatttcattcaccactcgcttttgtgcatcggttaaatcaaacggtaaggtttgaataaaatctttaagtacttcattttggtactgcaaagctaaaccgtttgccacatgccgatcagcctgtttaatggcttgtaattgaatctgatataggaagaactcatgaaaaatagcgcttcggcgtgcttgctttgcttcaggatacgttttagggaaatgcatgccagcaattaagtcgcgttcgttcattaacttatagcgcgtgcgaatatcctctgggatcaattcgggaataacgtcctgatacaaatcaaaggcttcttgaatcatcttgaccagtgtcccttgacgcacacttttattaacggaatagatggccgcaaacgatggattctcagccgattgaaccgctaggaccttcatccccgtcaatgtatgacgtttagcatcccacttgccataaatagcgacatcgaccccggcttcaaacttgtccttaagatagggttgattaaaaaaagtaaccatcacaacgtcatgttcaatcaagagccgtacattcagccgggtcttccctggtccccaacgactgatgaccggatcagcgacgaccgttccttttaacgtcaccttttcctgatctgccgcttcggataaatccttgaccttcaaatcttcgtaacgaaacggaaaataatacaataaatcactaatggtccttatgccaagctgatcgagggctgtcagacgtttcgggccgacgccagctaacacagcaacagaatccgttaaacttaacattgacagcctcctgtaacgtgctttcaaaagcatcctgttgcgtttagcaccattagccaaacaagtagctacgctagtcattcggctaattaaactaatcctcacaggataagcacttttgatacacttctttttcttaacgtgctttttaaccatattccaaggttaaacgtacttctactaaaaaacgggaaccaggtatattcaacctcattcccgttttatttgattaactattcaactgaaatcaagtatgggtaaactggttgattcccttcgtgtacttcaacttctaattctgggtcttgggccataattgcatcactgatttgttcagcttctgttgcatcgccgtcttccccgataataattgtgacgatttcactgtcttcatcaagcattgtttggaccatttcaatggctgctgttaaacgttcagccgttgagaccttaatcttaccatcgataatccccatgtaatcgtctttcttaatttcaagtccatctaaagtcgtgtcccggattgattgcgttacttgaccactaatcacggtatctaacgcctctgtcatggcttcttgattagcagccaattcagcagatgggtcaaatgataagagagcggtcatcccttgagcaatcgtccgactttgcacgattgcaactggaatatcagccacttcggcagcttgttcagcggctaagaagatgttcttattatttggtaataagatcacttgtttagcattggctgctttaatcgcatctaaaatatcttgcgtacttggattcatggtttgaccaccacttaagatataagtagcccctaaactcttgaagagttcagcaatcccatcaccggccgcaatcgcgataatcccattttcaacaggttctgcttgcacaggggcagcagcttgttggtcgttttcaacaatcgtatcatgttgtaaacgcatgttatcgactttaatcttcactaatgaaccaaagtgttggccgtaagccatgactgtccctggatgttctgtatgcacatggaccttcaccacttcttcatcggctaccactaagagagagtcaccaacaccgtttaaatgattgcggaattcatcataatcaaattcgcgatcgacagttgtcccgtcaccaagggcgaccatgatttcagtacaataaccattttcaatatcttctgtacccatttgagcggtttgatgatgattggcattgaccatttcatccatttccgcttcatcaggtgtgtaaagatcttttgcaggtgcttggcctgttaaaccttctaagaaaccttcatagatgaagaccaatccttgaccaccagaatcgacaacgccgacttcttttaagacagggagtaattcaggggtcttcaacaaggccttcttagaaccctcaacaacagcttcgataactgcaccgatatcatcagtttgaccggcaaccttggcaccagctttggcgccttttctggcaaccgtcaaaatcgtgccttcaacgggtttcattactgctttataagccgtttgaacaccatttgtgaatgcgtcagccaaatcttgtgcatccaacgtttctttttcagccatgctcttagaaaaaccacggaaaatttgtgaactgataaccccggagttaccccgagcgcccatcaaaagccccttggctaaactcttagataattcaccgacagattgcgcgttgttttcattaactgctttggccccactttgaaacgttaaactcatattggtcccagtatccccatcaggcactggaaagacgtttaatgaattgacaaattctgcatttttagtaagccgatgtgcagcaacccgcatcattgcttggaattctgctgctgtgatttcagtaactttcacgaatgttcctccttgaacaaaaacaaatagaactggacctagtggccagctccgctaattagttttagtcttctaatacccgtacaccttgaacataaatattcactgagttcgcaccgacacccaacattgtttcaagattgtacttcactttactctggacgttacggcaaacttcagagatcttaatgccgtaaccaacaataatatagacatcaatcgcaacgccattgtcttcttgacggactacgacaccccgattataattctcacgattcaaaatatcgtttaaattgtcacggatttgattcttacttgccatcccaacaattccgtagatatctgttgcagcaccaccaacgacggttgcaatcacgttattggtaatatcaatatcgccatattgtgttttaattttaacagccattaaaatagcctccttgtgccatacttattgttattttagcatagcggagaagagttgcaaagcaactggtgatgaattcttccccaaatgcggcttatttttggactttaatgagtttaaacgacttattttggactgtcaagtaaatttccttgaaagagctcttgcattccccaaactattatggtaaattatttaagtgaattgtataagccggtgtgcatgcatgcaactattaagactaactgaatcatattatgtttctcgttaattctaccggctttacttaaaggaggaataagaccatggcaaaagacgttattaccggccgtaaaacatcatttggcaacaagcgttcacacgctttgaacgcatctcgtcgttcttggaagccaaatttacaaaaagtacgtatcttagttgatggcaaacctaaacgtgtttgggtttcagcccgtgctttgaaatcaggcaaagtaactcgtgtataatttcaattgatagaccgccagttggcggtctatttttttggcaaagagtacgagataagtcggctaatcctcgggagatgactgatcgaacacgtttatggcaaccaaaaagacggctcggataaaataattttatccgagccgtctttttaatccttactttgaatcaccgcaaccaccccagtttcaaaactgaattggccggtctcaccgatgaactcattactagcccatgaaatcgggacttgcgtttggtaatccaccaagcgatatttttcatcaattaaatttaaaccagttgtgggaactaatggcacaaaggccagataccgtttatcggcttctttttgtaattgatacgtccctggtgcatagaaccgaatcgtattttgccgatcgcgcatctctaaccggtctaaaaacggcttaaaacgtgtttctaagggcataaagagattagcaagaaaatggtccaaccgaccgcctgttgcgccataaagcacaacttgatccgcattaaattcagttagcgcaattaataatgccaactgagtgtcggtatcatctttttctgcttgcacagagcgaatatcctttactgctgattgaacggtggtccgctcagccgccgtcaatgaatcaaaatcgccgactgacacgacaggtgttacgcctttttgcaataagcgccacgtaccacggtctgctgtcacccattgaccatcaatcatttctggctgcgccaattcgggggcccactcactgactggtcctcccaccaacacattaatccgcgtcatgagcagcctgctttaaagttgcaatccgggttgctaaatcaccggcaaacgtatatgaaccggcaacgaaaacatctgcgcctgctttggcacacgcaccgatggtttggtcgttaaccccaccatcgacttcaatcgtataatctgcatcagcatgttgatcgcgataagtcgctaattcagtgaccttatccaacatcgctggaataaacttctgcccaccaaaaccgggattaaccgtcattactaagacttgatcaaccaatgataagactggttcaatcgcactaactggtgtccctggattgatcaccacgcctgctttaacaccagcatctttaatcatctgaagaccacggtagagatgttgcgttgcttcggcatgaatcatgattaagtctgaaccagctgctgcaaattgttcgatgtagcgttctggttgttccaccattaaatggacatctaagcctaacgttgtcaatggccgcaagccagttactacttgggggccaaacgacatgttggggacaaacatcccatccatgatatccacatgtaatagatcagcgcccgccttttcaaggttttggacgtctctttgtaagttcataaagtctgcgcttaaaattgaaggtgcgatttgtttcatcatcaaaactccgatcacatttttattttgacttcttgtaaactggccgaatatcctttaattctgctctaaactgtaaataattcgtataacgactttgcataatttcgccactgtcgacagcttctttcacggcacatttcggttccatcacgtgttgacacgttctaaacttgcatccttgcccgatttctctgaactctgggaatcggtcaaccaaggtttcaatcgtgacgtttaataaaccaagtgatgaaaagccaggcgtatcaccaactaacccatcattcaacggaatcagttcaatatgccgggttgtatgtttcccacgatttaaactctgcgaaatttcggcagttgcaatattcaagctcgggtcaatgtggtttaacaacgttgacttaccggcccccgtttgtcctgtaaagacggttgttttatgcgggaacgtgtcttcaattgccgtaattatctccggtgtaaaggcggtccgcggtgcaaaaatttgatagccgatcttcgcgtaatacgccaagtaatcactaatttcttggtattgttgatcactaatcatatcggtcttggttaaataaactaacccttgcatgtgcagcgattcaatataaatcaagaagcgatccaacaaattcaaggagaatgctggttccaccgccgaaacaattacgacagcattatcaatattagcgactggtggtcgaatcatctcatttttacggtctaaaatctcaagaatatagccactttctgtttcactttcactctcgaattcgacaaaatcgccgacaagtggcgtaattttccgtttacggaaattaccacgcgcacgcgttcgataaattttgccttcactttgtacatcataaaacccactgagggcgcgaataatctgtcctgtctgcaataggtcacctcccaattagtttgtcacatggtcatcagatagaatctcttgaccatttcttaaaatccggaaacggccggcttggtccgctttaatcgtaaatggcaattcaacggttgtatccgcggtaatcgtcatttctttataaacactcattattgaatgcgtgctatcttctaaataaatcgtaatcttattcgtcgtagccgttgaagtactacttgaactagagctcgtactactactgtcacccgattcgctcgagctgcttgtactactttgtgaagttgctaaggaattatcaaacggaatcgtaatcgacttcgtaaaactcttggtagcgggcgcttttttacctttagaaagtaccacgttaatattggcaccttcttgaatagatgcaccactaccaggtgattggctaatgactaacccttcatcaatcgtattggagtaatcctctgaaaaagtaaccgtcaaaccaacgtcatcaacatagtcttgaacagcctgtttcgtgtaattactcaaattgcgtaaagtaatgcttggcttgccgctgctgacagtcaaggtaatcgtcgtcttacttgggacaactttttcacctgcggcaatgctttggtctaaaaccagtcccgaagcaacactgcgtgaactctgatatttgcgcacaaccgtcagtcccttttgtttcaataacgtgctgacatctgtgaacggtttgtccgtatagtcttcgatctcatactttttacgacccgtactgattgttagatcaaccgtactgcccgatttaacatgcattcctttaccaggcgtcgataaaatcacatgccctttgctgtacttattgctagtagttttttgaatcttaccaacttttaatttatctgcggttaatgctgcagtcgcgttttcttgcgtcatgtctgtcacatctggaacagtcacttcactgccttgcattgcgtacgcagcgaagaccccgagcatcactaacaagactacgccaagccccacaaaccaccatttccgcttcgacttcttatgcggctgtttctttttctgatcgtcttttacttcagtctcatctttgggtttggcttctggcgcatcgttttggcgcgtaatcccttctgggtcgagagccggaatcacctttgtttcacccatatcaccttgtgagggcacgaatttcggttcatgcgcccgactagctgataatgaggtactcaaatcagtggtcatttgcccaacatcactgtagcgttcgtccggatctttggcagttgcttttaacacaacgttttccaaagcttgtggaatccgcggatcataatctcgaacgggtggtacagcatcttgaaaatgtttaatcgcgatggaaacagccgattcaccttcaaatggcaccatacccgttaacatttcatacagaataatcccgagtgaatagatgtctgaacgtttcgttgccattgaaccccgtgcttgctctggtgataaataatgcactgatccgagtaatgtattggtctgggtcatcgcggtttcactgagcgcaatcgcaatcccaaaatcgctaatcttaacgttacctgcttcatcgaccaagatattctgtggtttcaaatcacgatgaataatatcgtgcgcgtgggcattttcgaccgctgataaaatctgcgtcataatatcgacgacgcgttgataaggaatcgggaagtgttcaacgatatacttctttaaatctgttcccttcacatattccatcacgatgtattgcacgctgttttcttcaccaacatcatagatactgacgatattggggtggttcaattcagttgtggcaagtgcttcgcgtttaaagcgacgtaccgtgttcggatcattccgtaaatcaagtcgcagcaccttgaccgccacttggcgatccaaaatcagatcttgggccagataaacgttggccatgccaccttctccaattggacggataatctgatagcggccattgaccgcgtagcctgtctccatcatcgcgcaccctcctcaccagtttgatgtaagattaacgccgtaatattatctaagccaccggcatcatttgcttgttgaattaatgccgcacatttttcttccagcgatgtcggtgtcatcagcgtggtcttaatttgttcatcatcgaccatattggttagcccatctgtacataataatagataatcatctggttcaaattcgtaaattgttacatcggcatcgacatcttgcgaaacgcctaatgtgcgcgtaatgatgtttttttgcggatgatgctttgccgcttcttcggttaactccccttgtttcaccaattcatttaccaaggaatggtcctctgttaattggcggagttcgttattccggaagcgatacactcggctgtcgccaatattggcaactaagtaattggcacctgaaatcaacactgcgacgagcgtggtgcccatcccaaacaaatcatcatactgattagccttcgctaaaatatgtttgttttctttttgtaattcgaaaattaaccatttaaccatggattcaatgtcggtatcatcagttcgttcgaactcgtacccaatatgggaaaccgccatttctgaagcaacatcgccgcctaaatgaccgcccatcccatcagcaacaatcgcaaactgcgcaccgcttttattggtataaaagccgacatagtcctgattattttggcgttgttggccgacatcggtttgaaaagcaacttccataagaattcacctcaattaataatttaagcccgtcgtgttaaacaagcgatgaaaaagccgtctgtttgataatcatcgggatagatttggacaaacggtgtcgcttgattggctggcaatggtttgtcgagtgctactggtacgatttcaaattctggatgattggccacaaaagccgcaacaacttgttgattttcttctgggacaatcgtacaggtactgtaagtcaattgaccacccacttttaaggttggtgcaacggcttctaaaatcgccaattgaatcttttgaaggttcaataagtctgctgcttggcgaccatacttgatttccggtttacgtcgcattaagcctaagccagaacatggtgcatcgactaaaatcttatcaaatgtttcaggttcaaattgttcaccgactttgcgtgcatcgagcgcccgcgtatcaatgacgtctgcaacatgcaaacgcttagcgttttgctcaatcaagcggactttatgttcatgaatgtctaaggcagtaatttgccccccttgactggcatccaaataagtcgccatatgtgtcgttttcccacctggggctgcacaagcatccaagatccgatcacttggttgtagttgcaaacttggtgccactaacatcgagctttcatcttgaattatatacgcgccttgttcgaacaattcaccgctggctaagtgaccgccgtgggcaactaatccagcggctacaattacactcggttcaatcgttaacccgtcagcctgtaagtctgccaaaacggcatcaactgaattaacacgggtattgactcgaatggacgcattcgctggttggttaatcgttgccaataagtgttccaattttgattgccctaattcttggtggaacttcgccactaaccactgcggcatactgtaactcacacttaggcgttcgattggatcggcaattgctgctaaatcaggcaatccagtccgttgttggttccgtagaattgcggtgaccaacttagccgtgccagcatggcccatttgtttggcaatctcagttgcttcataaaaaatcgcatgttcaggaacacggtccaaataaacctgttgaaaaactgccgtccgtaagacttggcggacccaagttgccagtttagctggtttttgaataaagggggctaggtaataatcgagtgtcatttcatgttgaatcacaccatacacgagctgcgttaaaaaaccagcatcttggggattcaagtggttttgtttaatcacttggtcgagggccaagtttgaataactgttttgtttggcaaccgccgttaaaatttcaacagctaaatagcgtggtgtctttttaggcatcttgcaccaccacttgttgtccgactgcgagttgtttgccaaccccgtttaagaaagattggaccggcattttagccttaccagctggttgaatctcggtaatcttcaaaacactgccattgccagctgctaattcgaaatcctttttgttgatagcgacaatcacaccggctggttgatccgtcgttgtttcagcaacagttgcttgccataattttgtccgttgaccattaattggcaaccaagcgcctggttgtggccgtaacgcacgaatctggttgaccagttgcgttgctggttgctcgatatctaattgttcttgttccttagtaatattgtaagcaaacgttacttgtgcttcatcttgtggtgtccggggcgcggtttgatcgataatgcttggtaatgtcttcaataatagatctcgaccgacataacttaacttatcaaataaagtcccggtgtcgtctgaagcttcaattggaatgctggcttgttcaatcatatcaccggcatccatttttttagccatatgcatgatggtaatcccaatttctgaatcgccgtttaacacagcatattgaatgggtgcaccaccacgatattttggcaagagtgaaccatgcacattgatggctgcaatcttagcggcttctaataacttcgttggcaagaattgaccatatgctgccgtcacaattaaatctggttgcaaggccatcacgtccgctaattcttgactaccactgagtttttcaggttgaaaaacagtcaggtttaagcgaacagccgcttctttaacgggtgtttgttgtaagacttgcttgcggccaactttccggtctggttgggtcacaacggctaggacttgataatcgtgtgccacaagggcttctaaaatcggtactgaaaattggggagtccccataaatacgatggatgtcattaatcaatcacgctcactttaagtaaattgtaggggttcattgtccaacccaatcttgaaaccatgacgggtatcaatttgggtcgtttcgagaatctcggcgagtttcgcctgaagttgtggttcctgtttatatttaatcacaatttgatagaaataacgattattaatccgcgcaatcgacttcggcgtcggacccagcacaatcgcttggtcggataagacgggccgtaattgacgggcaatctggaaactcttcttggctgccaacgcttcttcaggatggctaatcgttaactgtaccgtaaaataatacggcggatagccgccccgatggcggactgccatctcatattgatagaagccttcataatcatgttgcttggcaaattggatggcgtaattttccggattaaaagattgaacgataaccgcaccgattttatcggcacgaccagcacggccactgacttgcgtcaataattgaaacgtgcgctcacttgcccgaaaatcaggtaacccaagagcggtatcggcgttaatcacgccgacaagcgttacatcgggaaaatcaagccctttggcaatcatctgcgtgcctaataaaatatcggcatcgtggtcgccaaagcgtttgagtaatttagcgtgcgcaccttttttgcgggttgtatcaacgtccatgcgtagaatacgagcatttggaatcagctcttggagttctgcttcgactttttgtgttcccgttccaaaatagcgaatctggcgactctgacaatttggacaagtccgcggaattgcttcttcatgaccacagtaatggcacttcatcgagtgcgtatccatatgcaacgtgagtgagatatcacagttgggacactgcaagacaaagccacaatcgcgacacatgataaaggatgaaaaaccgcgccggttcaacaagaggacactttgttcgcctttttgcaaccgatccttcaacgcatctaatagtgcaggtgagaagttgctgctggcttgttgcttcatcgcctcgcgcatatcaaccaactcaactgccggtaatggctgttgattaatccgttgcgtcaggcgcaagagttggtagacgcctttttgggcgcgggcacgcgattcaagcgacggtgttgcactcccgagaatcactgggcaatgatggtactgactccgccagatggcaacatcgcgggcatgatagcgcggactttcatcttgtttataggaagcttcatgttcttcatccatgataatcacaccgatattctccaatggtgcaaaaacggctgaccgcgccccaacgacaacgctggcttctttgcgttcaattcgccgccattcatcatacttttcaccttcggataagccactatgtaaaacggcaacttgatcaccaaagcgacccttcacgcgtttgaccatctgcggggtcaaagcaatttcagggactaacattaatgcagttttcccctgttgcaagaccgcatcaatcgtttgcaagtaaacttcggtcttaccgctgcccgtaatcccttcgactagaaaaacccgatcagattgggccttagtagccgccacaacggcttctaccgcatcagcctgttcatcagtcaacgccattttttgcgtcgtcgtgacggttttaggataaggatttcgataagcttcaactttaacttggcgtaaccaacctttgtcggcgcctgtcttgatattctcccgggtaaaagtcgtcttggtcaaaacatcctttaataagggattgggttgatcaattaaactttgtaaataactaatgagttgactctgcttttgcgctgacttacgtaagccggtccgcgcttcttctaactgttcaaacgataatgccggttcaatcgccgttaattgcttcacgcgggcgcgatcatcgacatggtagaccacttcgattttcccttggcgttgtaactgcatcaattgttttaacttttcgggatctagcgactggtcaaacgttaattcgtcgttaccattgaacaggcttgcttgtaaggctggatcaatttcatcaactagttgcgcggtcttagagtacttagcacgcatcacacttgggagcatcgtttgtaagcacgtaatctgaaaggcataggtccgctctgccaaccaacttgataattgaagtaattctgaattcacagccggttgtaaatcaatgaccgccgtaatcggctttaattgcccctcaaaattggcttgatcttgaatggacaagataaagccttgaattaatcgatcacctttgccaaaaggaaccgccacacgcatcccaggttgaatactgtctaataaagtatccggtacttggtaatcgtatggccgattagtttgcatcgtcggcacatcgacaatcacttttgcgatttgtggcatctgaatcctcctttttagttaagctaacaagtcagcaactcgttctagaatttgagtcgcaatcacccttttatccgccaacgctaatgtttccggtgctgcattcggttgtaaaagcgtaaccgcattttgatcaacaccaaagccccgatcatgctgactgacatcgttcgccacgagtaaatcaacatttttagctgctagtttggtttgggcattttgtagtaaatcatctgtttctgccgcgaatccgaccaagaattgatgcgtcttctgttgcccaagcgtcgccaaaatatctggggtacggtctaaagttaactgcatctcagttgtgttcggttgttttttgattttgtgcgtgacatattgggccggtttaaaatcggcaaccgccgcagccatcaccacaacatcggccccttcaaagacactgctaactgtgccttgtaattgcgccgccgtttcaacgtaaattattttgtgcaaaccagccgggactggcaattctggacgcgtgctgatgaggatcacattcgcccccatcgtcacggctgcttgggccactgcataccccattttaccagaagaccggttgccaatgtagcgtaccggatcaattggttcttgtgtcccaccggcagtcaccaccacgttctgcccgtttaaccgttgcggtccgaattgttgcgcaacttctgccataatcgcggtttcttcagggaaccgcccgacgccagcatagccttccgctaaaaagccggtatccggttccatgacagtatagccatctgctttaagttgggttaaattccgttgggtagctggattaaaccacatatgttcattcatcgccggcacaattaatttgggcgcggtagtggctaacaaggcggtcgagacaaagtcgtcagcaatcccattagcgagtttcccgattagattagcagtcgccggagtaatcaccgccagattagtccaatccgctaagtgaatatgggcaacccgatccggttggtcttgattaaacaaatcagttaacacgggtttacgcgttaatgtggcaaacgtcagtggcgtgacaaattcggttgccgcctgagtcattgccacttggacctccgcacctgctttaatcaatccgcgcaccaaattagccactttgtagacggcaatgccacctgtcacataaactgcaattcgtttattcgttaaatccactttcaaaaccccctaaaactaaaaaaactgcactttaatttaaacatccatcgatgaataaactaaacatgcaggttctttaattattcttattcgccgtctttttgagcgagcttatccattttttcagcatctttttcaagcatcaatgaatcaggatcaataatgacattgccagcagcaatttcttccattgccatcccaaccgttttaggtgatttgtattcagataacatcttaatatcaccggcttcgatttcatgggcccgcttgctagctaaaacagccaatgagtaacgtgagttcacgttttctagtaacttatcaattgaaggatatacaatcatattattattcccctatcattttcttgtattggtcgatcacacgtggcactcgtaagtgttcactttcgataatcttttcgattcgttgaaccgcatttggaatttcgtcgttgacgacagcataatcgtaattttccatcatcttgatttcgtcggctgctttttgcatccgcttatcaatcgtggcttgatcgtctgtgccgcgtttttgaattcgattccgcaattctaataaatcgggtggtgtcaagaagatgaagacgccatcgggacacttctcgcgcacttgcattgcgccttggacttcgatttctaataaaacatcgcgccctgagtctagtgtctgattcacatacttcatcggtgtgccataataattatccacgtactgtgcatactctagcataccatcatttgcaatttcttgctcgaattcttctttgctcacaaaataatagtcaacaccatcttgttcgcctggtcttggctttctcgtcgtcatcgaaactgaatagtgaaaatcacgaaattcatcttctagcattgcttgacggacagttcctttaccgacccctgatgggcctgataaaacgatcaacattcctcgattggacatctacgtaattccctcttcttttataaaatagttaaagtctattttgcactatttggcgggaaatttcaagtctactttgtttccatctcatttaaaattaaccttaaggacgcaatttcgtcgtttgacagcgtcacacccttacccattttggcatgatccggtgcccaatctcgcaaatcaaattttggtgcacgttgattccaagagattaaattcaattctttacgccaaccggctggattttcactcaacacaccgatttctgccataatttcatattcaattttgcccatcaaatcaccctttctatcagctcatcctattatacacgaaaaaaatcaaaaaatgccgcttgcaattctgaacgtttgttcgtataatgaaaacacaaacaagtgttcggaggatgaaatcatggaatttaaacaagcaacggttagcggactcagtcaacaattggttaaacaatatcaccgcttttttgaacttacaccagaagcgactgcttttgttgaacaaccccaaatgcaacctgctcagattcaattatttatgccccaagcgtttgaacgccactaccatgttgcggtgcaattcaatgttaacgatcatctcgaacaagtgaccgggcgcttggttaaacaactcagtgcgaacaagtatctgctaaaagagtgtcgttcgaacctctacaagattgtcctttgcaatcaaattcgttacattcaaaagaaaagttaagcaaaaaataagggtgcagccaaaaaaatattttggctgcacccttattttaatgtcggcgactttgcttagccgtttccgctaatgccactaattcttcggcatgttctaaagttaactctgttacttcagtccccgctaacatccgcgccaattcagcaatccgttgtttaccggttactttttgaacggacgtttccgttcgattttgttttacctgtttttgaatttgatactgatgatcactcattgctgcgacttgcggcaaatgcgtaatgcagagcacttgcgaatgttggccaatttcactaatcttattggcaattgcttgggccacacgcccactcactccggtatcaacttcatcaaagatgatgctagtaacgccttgtgattcggagaaaatcgttttaagggctaacatcaagcgcgataattccccaccagaagcaattttagcgagcggccgtagtttttcaccagggttgggttgaatgtaaaattcaactttgtccatcccggaggccatgaactgttcctgttcatttggcaagaattcaactttaaagaccgtcttttccatgtataacgcttttaactgttgatgaaccgctttttcaagttgcttagctgctttttggcgtaattgtgtcaacgtttgtccgtttgtcctaagttgttgttcaagttgcgtgaattgctgctccaactcacttgcgttcgcttcagttgcttgcatcgctgctagttcagccccgattttttcaccataagcgagaatttcggcaattgaatcaccatacttatgttccaaattattaatagtttctagccgttgttcgatttcatctaaccgtgcttcatcccattctaagtttgaaacttcccgactaatatcaatgctactatcttgcaacgtgtaataaccagtctgcagactgtccgcaatacgcttgaattctggatcgagttcagcaatttcttgcatctgattcattgcaactgcgatttggtctaacgcattcccgtcttctcctgctaaaatcgtgtgactggcttgcaatgcttggttaattttttgaaagttcattagtttggctcgttcttcgactaacttgctttcttcatcagcctgtaattgggctgcatcaatttcgttagtttgaaatttcagcatatccaagcgttgggcccattcttgttcattttgctgtttttgcttcaaggcacgctgtgctttacgataggcagcataggtttcggcataggctgccttcgcggttgttaacttttggtgcgcaaattcatccaacaaccccaagtggcgatctggatacattaattcttggtgttcattttgaccgtgaatatcaactaaggtttccccaatatgcttcaaagtggttgtattgaccaaatgaccgttgacccgacaaacattgtgtccattaacggctaaatcacgctgtaataagacggtttgttcgtcgtgttcaatgccaaactggtctaatactgcggcggttgtgccattaggcgtcatcgtaaataagccttcaagggtcgcttttttagcaccagtccggataaagtcttgtgaaccccggccgccagcgagtaacccgactgcatcgataataattgacttaccggctccggtttcccccgagagcaccgtcatcccttcttcaaaactaattgctaactgatcgataattgcaaaatcgtgaatgaccaactcttgtaacatctgatcatccccctttcgtttctcttgatgctaaaaaaacttgccaaattactttagcaagtcttcaataaacttcgtaaactgtttagcattttcttctgatttacaaatcaccaacacggtgtcgtcgccgccaattgtaccaaatacaccactgagctgcatttgatccaaaagattagcaattgccgtcccgttacccggtaaggctttaatcacgacaaaatagtcttgttggttatgcgtaatataggcgtcacgtaaaatccgacgcaacttttctttaacgtctaatttcttttcaggcggtaggctatagtgatagccctcgtccgcatttggcactttaatgagctgcatttctttaatatcccgcgaaatcgtggcttgcgtaacatcgatgtcttccgcttgtaacagcttcacaaaatcctcttgtcgttcaatctcatgggtctggattaaattttttaacagtcgttgccgatctaccttgcgcattaaaacaccctcttcatgtgagaaattattctattcctcaatgatagcgcatttatacataaaatacaaagttttatacactattttcccgttggtcgtttcaaagcagcataggcattctctaaaaccgtatcaatattcatgtttggggccatcgttccagtctcagccgtcgtattccgtagatgaatcaagaattcaatattgccttcaccacctttaattggtgaaaaatctaaccctagcacgtcgtagcccgtcgctaaactaaaatcaacgatgtctttaaccaccatcttatgcactttcggatcacgcacaatcccgtgtttaccgacattttcagggccggcttcgaattgcggcttaattaaagcaaccgcttcgcagtccggtttcaagatgggtttcaacggcaccaaaatcttatgtaacgaaataaacgaaacatccgtcatggcaaaatctggttgaccattggtgaaatcttctggttgactgtaacgaaaattaacccgttccatcactacgacgcgtggatcttcgcgcaatttccatgctagttggttatagcccacatctagtgcgtaacagagtttggccccatttctaagcgccacatcagtaaagccccctgttgaagaaccgatatcaagtgcgattttatcctgtaaatcgatgttgaaaacctcgaccgctttcgccaattttaaagcccctcggccaacatacggaatcttacgccctttgacacttaagacagtttcagcgtcgattttttcgcccggtttgtcgattcgttcatcatttttaccgtacacttcaccagccatcacagaccgttttgcttgttctctggaatcaaataatccctgttggactaataatacgtctacctgttcttttttcatctgttctcctattcattaaaatagtttaaaaaactatttaatagtgctttatctaacccggataaatccgttaaagcagtttgcgcggcctgataagtctcatccaacgcgtcttttgcaccggctaagcccaataagcctgggaaagtattcttatgttcgtcagcatccttatggaccgccttgcccatcgcttctgtagtgcttgtcacgtctaaaatatcatcttggatctgaaatgccaacccataattttgcgcaaaaagctgtaaactagccatttgttcatcggataaatcagccaaaatcgcacctaagccgaccgcgcattcaatcaaacggcccgttttgagctgatggacttgtttcaattgaactaacgataaagttttagtttgtccttcgatatcttcaatctgaccagcaaccatgccacttggaccggctgcttgcgccaataattgaacagcgcggatctgctgatcagtcgtcaaatcggtcgtcgttaaccattcaaatgcaagtgtcaataacccgtcgccggctagaatagcttgcgcctcgccaaaaaccttatggttcgtaggttgaccgcgccgtaagtcatcattatccatcgccggtaaatcatcatgaatcaatgagtagctatgaattaattccaatgcccccgctacgcgatacgccatttgattaatcggtcgccccgcacttgcaagcaccgcaaataccaaaagtggccggagacgtttcccgccagccatcactgaataggtcatcgctttttgcaaggttggttcttcaatctgagcaagttgctcagtcaaataggtttcaaatgcgggcacttgttggcgcgcaaacgttttgaaatcaaccattattcttgtgcctcagcatccaatgggacttcttcgccattatctgccatcactttggccatcgttttttcagccttacttaaggtttcttctaatgtttgacttaatttaacacccttttgaaaagcagtcatcgctttttcaagtggcacatcgcccgtttccagttcattcacaattgcttccaattgtgctaagttctcttcaaatgttaatttcttttctgccatcttattcgtctcctttatgagtggccgtgacacgcgcgttcacgaggccatcttggacatgtaactcgattgattcgtcgaccgtaaaatcggtcatttttttcattacattttggttatcatccgttacataagcaaatccgcgtcccaaaattttcaacggacttacgagatccaaggccgccaccgcttgtccagcctgttgccgccgattttggacaaggctctcgattgctcgtttcaaacgatgatcggtatcagtcaacattctttgtgcttgttgaatcgcaccacttggtgattgcgactgcaggcgttgctgcaagagttgtacattctgttgactagtctgtaagcgttgttgttgcgccaacaataaacgacggtgcaactgatcgacattttgtaaatagccgtcatacaagcgttgcggctgttttaagacgtaactgttctgtaagtggaccaattgctttttgtttaatgccaatgttttcgaaaatgcctgatataaccgcaaacgttgttgttgcaacttcaacacttcgtccgtcaaaaccggtgttgctaattcagctgctgctgttggtgtcgctgcccgaacatccgccactaaatcagcaatagtcgtgtccgtttcatgaccaactgatgaaatcaccggaatctgactggcaacaatcgcgcgcgcaacgcgttcttcattaaacggccataaatcttcaatcgaaccaccaccacgaccaatgataattgtatcgaaatccccttgttgattaacttgattcagtcgatcgactaaaatatcagccgcaccgtcaccttgaaccaccgctgggaataagacgagttgggcaattggataccgacgttgcgtcgttgttataatatcgcgaataacagccccagaaggactcgtaatcaccgcaatccgttttggaaagcgcggcaatagttgctttggtgcatcaaacaagccttcagccgataatttagcttttagctgttcataggcttgatacaatgcaccaagaccatctggctccatccgttccacatagatctgatagtttccagttgcttcgtacaaggaaatccggcccacaacaagcactttcatcccctcttcaggagtgaacttaatcttttcaaaagcggacttgaacataatggcactgatcttagctttattatcttttaaactaaaatattgatgcgcattcggtcgtaagcggaaatttgaaatttcgccggttaaataaacccgatccaaatacggatcgcgttcaaatttagcctttaaatactgcgttaatgcggtgactgttaaatagtctgttggtttaaccacgtttagcacgttcctttgcaatctcaatcgtttgatccatgagcatcgtaatcgtcattggccccacgccacgcggaactggcgtcatcgcactaacatgtgatttaagggcttcaaaatcgacatcaccggtgactgttccatcttcaagccgattaatgccgacatcgacaacaaccgccccttctttgacatcctcaatgccgaagaagtgtggtttaccgatggccgccactaagatgtcggctgttttcgttagggcttttaagtctgccgttctgctgtgcgcaatcgtgaccgtggcattggcattgagcaccaaggctgccaatggccgaccaacgatgttactccgaccaacaatcacgacatttttgccagccacgtcaatatcgtgagctgccaataagcgcataatcccatttggcgtacaggccactaagcccggttgattaagccataatcgcccaatattgactgggctaaaaccatcaacgtctttttgtgggtcaatcgcccggataatatggtcttcattaatttgttttggtaatggtaattggactaaaatgccatcaacggtttcatccgtatttagttggcgaacaaccgctaataaatcagcttccgttgtttcagcagacaggcgttttaactcagatgccatgccaattttagtcgctcttttttgcttgctttgcgtataaatcgcacttgctggatcatcacccaccatgacgaccactaatttcggggttaccccttgttgtttgagtgttgccaccgccatttgttgtgcttgtgttaattcatttgcaagtgctcgaccatctagtaattccaaagttaacaacccctatttatcgatatttgatgtttctattttaacatagttaatcggttaattccgggttatcagctgataatgaccgtttaaattcaaaaaaacacgctaaaaaaatactttttaacgtgttttaagtgatttcgttcgtattttactaattaagcttcaacgaatttagataaaacgccgttgataaaaccttttgcttgatcatctgtaaattgtttagcaagttcgagcgcttcattcaacgccactttatcgggtgcttctgttgaattttgcatttcaaacaaccctaaacgcaagataattaaatccggtttggctaaccgtgatagttgccagcccttcttcaagtatggcgttaaagcggcgtctaattctgcttgatgttctgtgacgcccgttaccaagaaggcaaggtagtctggaacagcaacttcttcaacttcttcagcatcgaattgatccatggttaaaacggcttggtaagcatctgccaattctaatgtgtcattagcatttaacgcaaacaacacttgaaatgcagcttggcgaatttggtgtcggttaaaattaggcattaagattggtctccattttgatcaggtgtttcatcgttaaataagtcatctggatcaataatttttggtgctttttcagtgacaacacccaccacgtgtacgttgacttctgctagttctaaatcagtcatgaacaataattgttctttaagggcttcttgcatcgcaagggcaaccttcggcacagaaacaccatagttcagataaacataaacatccgcattcactttgccatcaatcaccttaagagttacccctttaccgtgattcgaacgaccaaacaattcgttaatggatgatgataacgtcccccgcatttggtggaccccatcaatcttgcttgctgcaatccctaaaatcacttccacaacttcaggtgccatttgaatcttgcccaatgcattttcttgtgtatcaagtacaatatttgtttcttctgccatcgaaacccctcctaacaagttcttgctaatttagcctatgcccgtgagatgtaactcccatcagatgtgttaatcgttaacaaatcaccttcgttaacgaaaaacggtacttggaccactaagccagtttcaagtgttgctggtttagtaccacccgaagatgtatcaccacgaacaccaggttctgttgcagccactgctaaatcaaccgtgtttggtaattcaacccctaaggtttcactaccatacatcatgatagaaacttgcatattttctttcaagtatttcaattcatcattgatttgtgctgctggtaattctaattgttcgtaagtttcagtatccatgaagacgtggttgtcaccatctgcataaagatattgcattgattttgtatcaatgattgctttttcaactttttcagttgaacggaatgtcttttcttgattggcacctgttcttaaattcttaagttttgagcggacaaaagcgccacccttacctggtttaacatgttggaattcaacaatccgccataggttgttgtcaaattcaatggtcaagccatttttaaaatcatttactgataacattgtttatcctccgagcattatataagtatgccattgtcctaatcatagcaagaaatcaggctcaaaagcaagtatttctagccttttatccctaaaagtagctataaaaaaagggaccggcacccgccaatcccttttagcgtattcaatcaagcaaaagtcgatctgaacactcacttttagattgtcaatggtttgttgcctgagtaattagtataccagtaaaactggatttacacaaacagagtgtgacatcagtctgggatatctcgaggattaacacagagttgcaaaagattgtggagcaatcatttgtgactcagggttaaccggagagatatgactgatggaacacgtttagaatgtgacgacacccccgcttctctcgcacaaaaaaacacccacataaagtgggtgttagaaaaattatttagcttctgcagcgtatacagaaacctttttcttgtttttaccgaggcgttcgaaacgaacgacaccttcgataagagcaaataatgtgtcatcgccaccgcgaccaacattttcacctggatgaatctttgtaccgcgttgacggtaaagaattgaaccagctgttacagtttggccatcagcacgtttagaacctaaacgacgacctgcagagttacggccgttagttgttgaaccgccacccttatggtgagagaagaattgtaaattcatttgtaacatctaaatgcacctcctgtttattaactgtctatttacgttttgtttgtacttgaatgtactgcccgtattgttgcgtaatatcttcaagcgtcaactgcaaattctgcaagagaatctgagctgtcgctaaagcttggcccgaaaccgttgccggaatctgacaagttaacaaaccaccattcaggttatctgcttctacctctggttcaaaaccagcaagcttttgcaaactgttgattgtcccgattgagacagcagaaacagctgcacagacgatatcactcccgtaaggacccgagtcggcatgacccgtaatttgaaaagaaataattttcgaatcggcattgaccgtaaagtcagcttgaatcatcttatttccctcaattaggcgttgatagcgtcgatcatcactttagtatatggttgacgatgacccttcttttgatgactgtgtttcttaggtttgtatttgaaagtaacaactttcttttcgcgcccttgtttttcaacagtaccatcaacagtaacaccatcaatgtttggtgtaccaaccttagttgtttcaccaccaactaaaataacttgatcaaaagttactttttcgccagcttctgcggctaacttttcaacgtagattgcttgaccagcttctaccttatattgtttgccacctgttttgataattgcgtacatgtgtgcacctcctattttttcttagactcgccaactaaggtgactaatcatagtacttaatgccttagtatgcgcggttgcagctgtggagctcacaattacaacgttcatattatatcgaatatcacagggcgagtcaatgctttattacgcctcgacaaaaaattgtgcgacatcgaacgtcgtattaggtgtttgtaccaattggtataacatcttagccatgtagcgtggtgaatacacaagcccgtcattgacccacttaaagaccaacgctaaactggcccccgctaaataatcaatcgtaatactcatctcaatttgatcagcctgtgaagtctgattatagcgcttagccacgtaatcctgcattaattggcgcattgattcagtcagttgtgcctgaaagtgaagcgtcgcctcatttttatagaacactttaaaagcagcttgttgttgttcaacatattcaaaaagtgcctgtaaactgacctgacgatatgtctgatcgaccactacagtcacttgctgataaaaatcggccaccaaatcggccaccgcggttcggatgaaatccactttatcttcataatggagataaaaggtcccgcgagtaattgccgcttgcttggtgattgcttgaatcgaaatcccctttggcgtactgtctttcagcaagataatgagggcttgacgtaattgttgctttgttcgttgaacacgtggatcttgcgctcgtaaatctgtctcacgaaccatctgatagttcccccaatcttttaattaaattcacctgtcgatagtatagccgctcagtgaaaagtctgtccattaatcggcttgataacggcccttgatcagttgaatatcccctagtgtacactgtaaatttgaagattctgttaacgaacacccaaaaagtaaactttatcccccacaaatttaattgttgttcgtctgcggttatagtaaaatgagcgtagtatttcaaatcggatagcgttaggtggtcgtcactttgatttctgcattcttcattattttcatttcaatcgttttattcgccgtcattgctagtcaattgactttcaaaatcggcttaatcacaaattgcgtgctctttatcattttagttggtgttgatgcttatctattcagctggggtagtggttctcactgggtgtacgttattgtcagcctactcggattagtcgctagcgaattattattagctgaactcccccatcttaaataattaggttaacgtcaaaaagcggtccaactcatcattgagttgaaccgctttttttagtgcccctgccaaggactctcagtataccatattaatcaagtaaggttgtttctttcacttcatcaattgtcttggtaccagccaactgcatggtaatcgataattcatggtttaagtgttcaaaaacagattgtaccccttgggcgccacctaaatttaaaccataaataattggccgaccaatggccactaaatcagccccacttgcgagtgctttaaagacatgttcaccacggcgaataccactatcaaaaacgattgggacgcgttttgcgacttattgcgcaattaaaggcaacacttcaaatgaagcaggcccgccatctaattgacgcccaccgtgatttgaaacccagatgccatctgcaccagcttgaatggcaatttcagcatccactggtgattgaatgcctttaacaaagactggcaaatttgtgatttgtttaatcttttgaatatcttctggtactaatccttgtttagcggcagcataaatttcagagatgcccttcccagcaccgtcagaattactataagctgctaaattaggcattggtagtgggaattggaattgcgtctcgatgtccgcttcacgataaccacccaaagttgaatcgacggtgagaataatggcttttacacctgccttaacggcttttttcaataagaactcattgaattgatcatctttactcatatagagttggaaaaattggggggcatcaggagccgctgcggctgcatcttccaccaatgtattggcataggtactaattgagaaaatcgaaccagccgctgcgacccctttagcagtgtcgacttcccctttttcatgtgctaacccttgggctgctgagggggcttgaataatcggcgtttttaaatcaatatcccataatttagtatgtaaatcagcatgatcgatgccttttaacacacggggcattatttttttagtattgaaagcactggtattttcagccatcgtccattcgtcttcagcaccgccacggatatagccaaacgcgccagcttccattcgttctttcacgcgtccttctaacgacgctaagtttaaaatatcgattggattttccgcttcacttgtatgatatcccatgatagattccttctttcaataattgaatacctttatcatggttctcttatcaaaagtaagcaaacatttatactcggttatttcacttgcgttcgaaatccaatgtcttgccggtaaaaagtcgtcggtaaagcgagttgcgctaaatcccgatagacctgttgactagctcggcctagcgtctcagcagaataactagcggtatacaaacgcccgccagcgctgaccaattgattggcttgttctgcgacactagcgaaactaaatgtgctgttgcgttttgcaaattgttgcaaagtgggtaaaacaaacggcgttgtcgattgtgtcgggtaaccatctgaagccaccacaacacctaacgtaatgcctgataattgccactgtaacgttggggtttcccccttcaataattgtgcaaaaacttgggcccagtcgcccgtcatccgtggtagcaccacttgtgtttcaggatcaccaaagcgcacattaaactcaatcactttcaccccgtgttgtgtggcaattaagcccgcatacaagacaccggtaaaaggcgtttgacgttcagccatcgttgccacaatcggttctaaaatagtcgttaccgcttctgcaacgcattggtcactaatctggggtactggacaataagcgcccatcccacctgtattaggcccacgatccccgtcaaaggcgcgcttatgatcttgagcaaccggtaatggatagacgcgattattcgccaccaacgccatcagcgagaactcttcaccttcgagataatcttctatcaataactggggcacgccctgttcaaagaacgcctgaacagtttgccgcgcgctcacgtcattttgagcgatgacgacgcccttgccagccgctaaaccatccgctttaatcacaacgggataacgaacgtcatcgagggcatccagtgccgcttggacagtctgataggcttgataagccgccgttggcacatgcgcggccgccataatttctttggcgaaagttttagacccttccaatgccgcagctgctttacgcggtccaaagatcgctaatccagcgtcttgaaaagcatccactacgccagccactaacggttgttcaggcccaacaatcgtataggcgacctttttggcctgcgcaaaggcaatcatcgctgcaaagtcagtcatctcaatcgcaactgtttgaatcccatccaattgcatccccggattgcccggcaaacaatagaccgttgcaacagttgaactctgctgtagcgcacgcgcaatcgtgtgttcacgcgcgccgctaccgattactaatagatccatgatttgcctcctattggctagtgtttgaaatgacggcgaccagtcctcaccatactgattcctttttggttggccatgtcgattgaatcttgatccttaatcgaaccaccaggttgaataacagctgtcacaccatgttctgcggcgtattcaacgctgtcatccattgggaaaaaggcgtcagatgctaagacgaacggtgcttttaatccattggcttccgcttgttcgattgcaatcttcacagagcccacccgattcatttgccccgcaccaatgccgagggtttggtcctttgttgcgaccacgatggcattactcttaacgtgtttaaccacacgttgggcaaataacatcgcagcttgttcatcagccgttggtgttttgtccgtcacaaccttcaattcagatgcttgatcagtcacccgatcacgttcttgcacgagtaagccgcctaaaacagaaaccttttcgaagcgatccgcttgcttagcagcctcaaaatcaagcgtcatgacgcgtaaattcttcttcttttctaaaatggctaacgcttctggggtgtagcttggtgcgatgataatttctaagaataaactgtgtaattcttcggctgtttgaacatccacttcacgattcaaggcaatgatccccccgaaaatcgatactggatcggccgcgtaggctttttgccaagcttcatagatggttgcacccaagccgacgccacacggattcatatgtttcatcgcaaccacacaaggttcgctgaattctgcgaccactttaaccgccgcatccgcatctttaatgttgttatacgataattctttcccgtgtaattgtaccgctgaggcaatcgagaaagccgttggtaaactgctttgatagaacgctgctttttgatgggcattttccccatagcgcaacgcttgtttaaagtcgtatgaacgtgttaatttttcagggaattcgatgccgactgcttcggttaaataaccggcaattaagctatcataagctgccgtgtggcggaacgccttggctgctaaataacgacggtaatcaaccgcagcttgcccctcatcgacgacgtgttcgaggacttgcgcgtaatcttgttgatcaacgaccacgtacactgatttgaagtttttagcggcagaacgcaacattgaaggtccgccaatatcaatttgttctacagcttgcgcttcagtaatccctggtttttgaattgtttctttaaaaggatacagattgacacaaactaaatcgattgtctggatgtcatgggctgctaaagcggccatgtgtgttggttcgtcacgtttggcaagcaagccaccatgaatattgggatgaagtgttttaacccgtccatccaacatttctgggaaatgagtgacttcatcaatcgcaattactggtacttgcgcttcttgtaataccttgaatgtcccgcctgttgagatcacctcgtaaccagctgctactaatcctttagcaaattcaataattcctgttttatctgaaacactgaccaacgctcttttcattgattgaattactccttctattttggtttttaattaattcagcaacaacttgcggataaatcgcgtgctctgtatcgtgcacgcgttgttccaatgcggctaaactatcgccaggcaacaatggtacttttgcttggacaatcatcggaccgctatcgacaccttcatcgatgtagtgaatcgtaacgcccgtttcagccacttgtgccgcataggcccgttcaatacttcgtaacccagaaaaggccggtagtaacgacggatgaatattgataatccgttgtgggtaggtatgcaacaatactggggtaatcacccgcatataacccgctagcaatatataatccaactgtaacggtgccaacagcgcgacaattgctgcttcatagtgttgtcgatcatcataatcacttaagcggatgaccgtcaccggtacatttcgttggcgcgctttttcaatcaccggtgcgcccggctggtcacacactaaattcataatctccatgcccgctttttttaaggcgtcatcatctgcaagtacttcaaagttagaacccgttccagaagcaaaaatcgccactttcatctcatcaacccaccaattctattgcattttcttgtcgcggtttaaccgacccaattcggtaagcctgttcttgttcagcgttcaattgggcgaggacttgtgccgctttttctggtgcgacggctaagaccatcccgatccccatgttaaaaatgttatacatctcgagtgcatccaattgcccatattgtttaagtgccgcaaaaatcggtaagcttggccatgttcccaattgaatttcggccatcacgttgtcaggcaacatccgcggtatattttcaataaagcctccaccagtaatgtgggccgcgcccttaataaagccttgttcgataaacggctgacatgcttgtgtataaatccgcgttggtgttaatagccattcaccgagtgtctgaccaggcaattcgggtaagtgactgtcgacggacaacccatgttgttcgaagaaaatttggcgcacaagtgagtagccattcgaatgaatcccactggacgcgattccgattaatacatcccctgtttgaatcgtttcaccagtaattaattgagcttgatcagcaattccgactgcaaaacccgctaaatcataatgtttttcagcatacatacccggcatctcggccgtttcaccaccgattaacagcatgtcagcagcttggcagcctgcaacaacgccgctgacaatttgttcgatcttatccggctgcgtttgaccagccgctaagtaatctaagaaataaagtggcttagcgccttgggcaacaatgtcattgacacacatcgcgacacaatcaatcccgatggtcgcgtgtgcatcagctgcaaaagcaaccatcaacttggtcccgaccccatcggtacttgaaacgagcatcggattttcatactgccccatcgctaaggcaaactgaccaccgaagcgaccaatattttgattggttgcgccgacttgcttttgaatccgacgaaccacttcgtaaccggctgtcacatccaccccggctttttggtaagcatttgtcatgattgttgctccttatctgcttttaaacttgcctgataggcagcttcatagtcataaagtggcgttggatagtcgccgttgaaatacgccatacataatccggaatacggcgcatcttgctgtaacccaatcgcgtcgattaatccctgttcactcaaaaagccaagtgaatccgcgccaatcgtggcacacatctcagcaatactttgatgcgcgacaatcagttcatcacgtgtttgaatatcaatcccataaaaacaagggtacttcaatggtggggacgcaatccgcaaatgcacggataatgcgcccgcttctttcaaacgtttcacgatgtgcttgctggtcgtcccacgcacaatcgagtcatccactaaaacgattcgtttaccagccacaacacttttaaccacggcgagtttgcggtttaccccttgttcacgaagggcttgcgttggttcaatgaacgtccgccccacgtattgatttttaacgaggcccatttcatacggcaaaccactttcctcggcatagccactagcggccgataacgatgaattcggcaccccaattaccatatccgcatcaactgcggtttcgcgtgctaactgtttccccattcgtttgcgggccgcatggacgttaatcccacagatatcagaatccgggcgagcaaagtagatatattccattgaacagattgaatgcgtggtttcggttgtgaagaagtcagaatgtaacccgtccgcatcaatcgtcacaatttcgcctggctgcacatctcggataaaagttgcttgaacggtattgagcgcacaagtttcactggccacaacgtagcccccgtttgctaaacgtccaatcgagagtggtcgaaagccgttgggatcaagcatcgcaatcaatgaatcttgcgttaataataggtaggcaaagcccccacgaatttgttgaagggccgtcttaatttgcgcgtgcaaatcaggcccttctgcacgtcgaatcagatgcatcagaatttcagaatcagagctcgattttaagatggcccccgattgttcaagcatgcggcgcagtgtgaccgcgttggttaaattaccattgtgtgcaagtgcgaattgatcggttgcaaaatcgaataggaacggctgaatattttctaaaccgtgactaccagcggtcgcataacggacatgaccgattgccgcgtccccggttagttgggttaagtgctccggtttgcggaaaacatccgccaacaaaccacgattgcgataacccattaagtgcccgtgatcattagtgacaataccggcaccttcttgcccacgatgttgcaaactatgcaagccaaaataagtcatttggtttgcttctggactaccccaaatcccaaaaacaccacattcttcatttaaactttttatttcatttgacatggtatcgccgtctcccaacttaacttcgcttcagtcaccgataactcaacagttgattcagtcgtttgcacttgcataattggcgtggccgagaccgtcccaattaattgcgcctgatcttgacagaacgcttcaaacgccgtctgattttctggccgaaccgtgatgataaagcgggattgcgtttcaacaaataactgttgttgattaagggggacttgcacgcggcagccgagttgttctttaaaagtcatttcggctaacgcaaccgcaaaaccaccctctgataaatcatgtgcgctagtcacccagcccttttgaatcgctgctaagacgcaatcttgactcgctttttcagtggctaacgaaaagccgcttaatcgtcctgcaactttgcccgtcaacatcttttggagttccgaacccgctaaattcgtatccgtctggccaacgaggtagattaaatcccccgctgacttaaaatcttgcgtcgtgatgtcggctgtatctcgaatcaaaccgaccatcccaatcatcggtgttggataaatcgcttcgccattgaattcgttataaaaagaaacattaccagagatgaccggcgtatcgaaaacctcgcaggccgccgcaatcccttgggcactttgatcaaattcccagaatacctctggcttttccggattgccatagttcaaacaatccgtaattcccagtggttggccccctgccgcaacgatattccgtgctgcttcggcaactgccacttgcccaccgacttttggatcgaggtataagtaacgcccgttacaatccgtcgtcatcgcgagcgcttttttagtcccacgaattcggacgaccgccgcatcgcttcctggtaaaacgacggtattggtcttcacttgtgcatcatagtggctgtatagcgagcgtttgtcagcaatcgtggattggcccaataaatcgagccatgttcgtttaacatcattaatcaccgactgataaggcgccatcgctttaaattcagcgatgcgtgctggttcagtttttgctttatgataaatcggcgcatcactcgttaaagccgccactggcaaatcggccactaattgcccaccatgccacaattgatattgttgactctcagtcacttcaccaatccggaccgcatccagatcatatcgttcaaacaaggcaaccacatctgtttcatgaccagctttaacacaaagcgccatccgttcttgcgattcagaaagcatgatttcataagcggacatctctgtttctcgttgtggcacaagatcaagattgagaatcatcccagtacctgccttttcagccatttccgctgttgaagaaactaagcccgccgcacccatatcctggatgccgactagccaatctggatgcttcaaaattaattccaaacaagcatccattaatagtttttccataaacggatcacccacttggactgctgagcgttgggtcgccttgccatctgcaaattcatccgatgcaaaagtggccccgtgaatcccatcgcggccggttttagccccgacgtagaacacactattgccagcaccacgcgctttaccttgctgaatatccttttggtcgatgacaccaacgcacatcgcgttgacgagtggattagtctgataacatggatcaaatccgatttcaccaccgaccgttggaatcccgatacaattaccgtacccgccgattccagccacaacttcttgaacaaggtatttcgtgtggtcatccgtcaattcaccaaagcgcagactgttcaaaagcgcaatcggcgtcgcgcccatcgaaaaaatatcccgaataataccgccgacaccggtggccgccccttcatagggttcgactgctgagggatggttatggctttcagctttaaagaccactgcttgaccatcgccaatatccaaaatcccagcgccttcacctgggccttgcaacacgtgctgaccacttgttggaaattttttcaaaaccggcttcgaatttttatatgagcaatgttcactccacatcactgaaaataacccggtctccgtataattcggcaaccgttttagaattttagtacgaatcaattcatattcatcatctgataacccccattgctgataaagcttggtggcttggatttctgccgctgttggttgctttaacacggttattgccctccttttcgaatcgatgtgattaatgctgcaaataaacgttgcccatcatcgctacctaataaggtttcgactgcgcgttctggatggggcatcatccctaagacattgccggcttcattcgtaacgcccgcaatattcgctaaactaccattcacatcattttgataagtaaatgcaatttggtggttcacttttaaccgttccagggtctctgcatcgcaataataattcccttcaccatgagcaatcggcaaccgaatttgttcgttcggcatatagtgttgggtgaacatcgtaccggcattggtcacgttcaacgcgactgtgtcacagataaaatgggtttgtcgattcggcaaaagaacgcctggtaataacccgagttccgttaaaatttggaacccgttgcaaataccgataaccggtttgccagcagccgcaaacgccttaactgccgtcataatcggtgccaacttggcaatcgcaccactgcgtaaataatcgccgtatgaaaagcccccgggcactaatacggcatcaaaacctgccaggctagttgctgtgtacgggatatactcagcgttttcatgacaaacatcttcaattgcatgatataaatcagcgtcacaattggaacctgggaaaactaatacggcaaatttcattgattcgtcgccaccttttgtatgtcgtagtggtattgttccatattaggattggctaagagttgatcacagatttgtgcgacctttttttcaactgcggcttggtcatcgccagccacttgcatttcaaaggacttgccaatgcgcatgccgctcacaccatcaaagccaagtcgttcgatagctttttggacagcctggccttgtggatctagcaccgaatctttataagtcacttgcacacgcacattaaacatctgtagaaccccctaaaattttttctaatcgtcgtaatacgacatcgtacaccgatactaaatcccctttgttcaagcggaaaacatccttatctagcgattcatgcgtcgtttgatcccacagacggcagttatctggggaaaattcatccgccaaaatcaagcgaccgtcataccggccaaattccaacttaaagtcgattaaatcgatatccgcacggtcgaataaatcgattagcagctggttgatctgcttagtttgtttttcaatcacttcaatttccgccggtgtcacaattccaagcgcggtggcttgcgaaatattgatggctggatcatctagtgcatcatttttgtaatagtattcgataatcggcgtggccaatcgtttgcccggtgcttgaccaaacttgcgggcaaaactccctgccaccacgttgcgcaatactacttctaggggcacaatcgtcactttcttgacgagctgttcagttgctgaaatattctcgattaaatgcgtttcaataccatttgccatcaagtatttgaaaattaatttcgaaatctgataattcaataatccttttcccgtaatctgttccttgcgtttgccatttaacgccgttgcttggtccttatagaccattctcaacacattttgatcgtcagttgtaaaaacatctttcgcttttccagaataaaacaacgtctcactcatgcttgaatccctccaaataacatacattttatttaaaattaaaataatcgttcgtgttacattagggtgtaaaaaaactttgaaataacctcatttcaaagttttcatcattattcgcccaaaccaacgcggtcaaagatttctgcgacgcggcgaatatggtaatggtaatcaaacgcgtcgtctaaatcagcgggcgtcaacacattcataatccggtcatccgcttctaacaacggtctgaaatcagtttgttgatcccaagcttgggccgttttaggttgaatcaagtcataagccgcttctctcgaaagcccatgatcgattaacttcaaaagaacccgttggctgtaaatcaacccgaaagtccgccccatattacacttcatattttctgggaagactgtcaagtccgtcataattttggtgaaccgtcgaagcatataatccaacaaaatcgtagtatccggtaagatgatgcgttcggcagaactatgcgaaatatcacgttcatgccagagtgcaacgtcttcatacgccgttaccatgtgtccgcgaatcacgcgtgccaaacccgtaatattttcagaaccaatcggattccgtttatggggcattgctgatgagcctttttggcctttcgcgaaaaattcttcgacctcgcgggtttcagatttttggagaccccgaatttcagtcgcaaacttctcgattgaagttgctagtaacgccatttcagccacgtaggcagcatgcaagtcccgtggtaagacttgtgttgagatttcttgggcgcgaattcctaaatgttcgcacacataggcttcgacaaacggtggaatattggcaaacgtgcccaccgccccactaattttaccggcttcaacgccttttgcagcttcttcaaaatgtgccttatgtcgttttaattccgaatactatagtgctagcttcaacccaaacgtcgttggttcagcgtgaacaccatgcgtccggcccatcatgaccgtatcttggtaacgtttggcttgtttggcaatcaccgccaatagcgcatcgatatcggcccgcaaaatggtgttggcttgtttcaacaaataaccatacgccgtatccaccacatcggtcgatgttaaaccatagtggacccacttgcgttcatctccaagtgattcagaaactgctctggtgaaggcgacaacatcgtgccgcgtttcctgttcgatttctaagatccgtggaattgagaacatcgcattggcacgaattttcgcaacatcttcagccggaatgtgtccgagttctgaccaagcctcatccgctaaaatttcaactgccagccatgcctcatatttattctggtccgtccaaatcgcacccatttcaggatttgtataccgttcaatcatttattagcgtcccctctagtcccaaattttagtctttttaattgccgttaacgtttcatcaacagccggcgttaataacgtgacgtggcccatcttgcggttgaccttttgaaccactttgccatagtcgtgataatgccaatctgctgactgccgactggctgttagcgctgcttgccagtgctgcccaagaatattgaccattaccgctgattgccacaattgtggtatttggagtggccagttgcagacgccccgaatgtgggttgcaaattgagaaaagtcacacgcttcaatcgttagatgacctgaattatgcggccgcggtgcaatctcattaacgtagagttgcccgtcatggccgacaaaaaactcgacacctaacgtgccgactaattcaatctgcgtggcaatttttgccgcaaccgattccgcttgtgccgctaacgccgctgaaatgcgcgccgggcagatgctgatatgtaaaatgttatctcggtgttgattctcgattgcgggaaaaacggcttgttgcccggctgaattctgactaattatgaccgaaatttcttgatcaaaatggaccatcgcttctaatacacaaacactagcggttaacaactgttgagccacctccatatccattgcggaccgtagaatgacttgtcctttaccatcatatccaccgcgcgtggtcttcaagatacaaggaaaaccaacttttttaacagctggtattaattctgcaggggtcgttacaatctcaaaggtggcatgtggtagctgttggtcaacaagaaattgtttctccaacaatcggtcttgagcaatccgcagcgccttcgtcccttgaggaatccatgtatattctcgggcagcttcaatcgtcttagcatcgacgttttcaaattcatatgtcaacacatcgacacgttgcgctaacatcataatttgtgcctgatcatcataagctgccacaatttgatcatccgcgacttgtccggctggacagtctgcctgcggatctaagataatcactgcaaaccccacctctttagccgctaatgtcatcatctgacctaactgaccgcccccaacaatcccaatcgtttgccctggtaaaatttggttagtcaaagtctgcattacttgccaccgcctttgcatgcatccgtgcttgatactgttgcagtgccacttgataagctgggacctgcaagccacaaatctgtgtcgctaaaataccagcgttaacggcccccgctttaccaatcgcaaccgtcgccactggtacgccacctggcatttgcacaattgataataaagaatccagcccactaagtgccttactttgaattggcacgccaatgactggtaagactgtattggcagcaatcatccccggcaaatgtgcggcaccacccgcaccagcaataatcgcacgatacccgttcgcctgtgcttcttttgaaaaggcgaacatttcatccggcatccgatgagcagaaataatctgtttcgtataactcacgcccaactccgataatacagaagcggtctgttccattgttccccaatctgatatagagcccataacaagtgccacatcactcatattctttgcccactttctcgttgttgattatgctttgattctaacaatcttcatctgatatgtcaaaatattttacgaactattttacataaatacatttaataattcgtatttaaatcataaatacacaaaaaaaacgattaacctgttggttaatcgtttttttatcgttatggcaatacaacgaagagtaatgcacctaaaatcccaccgatgattggaccgacaactgggatccagctgtatgaccagtctgaatcacccttgttggcaatcggcaagactgcatgggcaatccgtgggcctaaatctcgagccgggttaatcgcgtaaccagtcgtcccaccaagtgatagaccgattgctgtgataaccaccccaaccactaatgggttcaaaccggctgttaattcaccacgtgttaatgctagtaaagcgaagattaagacgaatgtcccaatcaattcactcattaaattggcaaatgggctgcgaatcgcagggccagttgcaaaagtgcctaagattgctgcttgatctttagtagcttgccaatgtggatagtattgaatccaaacgacaactgcgcctaagaacgccccaatcatttgggcgataatgaatggtaccaccgctgcccaaggggtcttgccaatcattgcaaaagcaatcgtcaccgctgggttcaagtgtgcaggtcccataaatgcagaggtatatacccctaaagtaaccgcaaagccccaaccaagcgtgatagcaacccagccagcaccgttggcttttgtttttgctaagctaacgcccgctacaacgccatcccctaaaagaacaaggataaacgtcccaacaagttcaccaagcgcctgaaccattattgaatgttccatgagatttcctccaagttaagtcctattttaaatagtctaattgtgcttcagcaattgctgaatccaataattctgtttgacgtgctttttcagcgtcatcccagttcaataaacgcgccatttcatcaacaactggttgtttgatggctgctaattgatcattgtggaataagatgaagtttgtccgtcttaaaagataatcaactggtgttaatgtcatttcttcgttaactgagtatcttaagctgattgtttctttcaagttcaagccttcagcagcaccttggtccgcgtatgaaacaacccggctgacgtttgaaccgaagcggtttgctaaatcaatcgcatcttcttcatcaatccctttgttcatcgcaacttttgcatagaatttaagggtatcatccacgttatttggatcgaagtgcccacctgaaacttgtaatttcttagaatcgatttcacgaactgtttcattgaaatctttcttcaagatatcccggattaattcaagcgcaccggctgccatcttacgataatcagtaatcttaccacctgataaagtgattaagccgttttcagccactttcaaatcactaccacgagaaacttgtgatgggttgactgattcttcagcatgcgccgttcttaattgactgattgctttttcaacatctgcacgagcagccgttttgttttcgtaatcatcaactgtcttgattaagttgttgaatgattcttctgaaaccttaccgctattagcgccaccaccgttataatcggagctaccgttattagaaattaatggtcgtaaacctgcccagctagcttcaatatcgtttaaagcgatattaacgctaggatagcgattgttgattgcttttaagaggtaatcaacgtctgcttgttcaacacgtgggtgtttgaaatcgcctgtgtaatcagtatcagttgtcccgaagtacgtcttaccttcgcgtggcacaacgaaaatcatccgaccatcatgtaagcctgaatcgaagtaagttggttgtggcactgataaacgactactatcaacaactaaatgaatccctttagtaggacgaagtgtttcttgtgctttgacttccgtgtttaaagcatttactttatccacccaagggccagcagtgttaatgactaatttggcatgaatatcgaatgtttcatccgttaattcatcgtgtgctttcaaaccgtttacgcgaccgtttgcatcataagtcattccgactgctttaacgtgacttgcgattgatgcacctaattcgtcagcttctttaatattttcgatgactaagcgcgcatcattattgacgaaatctaaataaacaccagcacccatcaaacggtctgacttcaagccaggttcgcgttggagtacttctttacgatcaattgtatagttggcatattgtgtaccagttacccctgccaatttatcgtataaatccatggcaatcttgacactgaacatgtcgtaagttgcttcaggttcatcatagattggtaaaagcattggtgtaggccgtgggatgtgaggtgcaatcccttgaacaacggcccgttcactaacagtatctgcaacaaccccaacgtcgaaagtctttaaataacggataccaccgtgaactaacttcgtcgaacgtgatgaagtcccttcagcaaaatcttgcatttcaatcaaaccggttttgatgcctgatgcagccgcttgaatagcaaccccagcaccagtgatcccgccaccgattactaataaatcaagttgttcgttctttaagttattaattacttgttgacgtccttctaatgaaaatgtcattataatcctcctcattcacgcattttatatggtcgatgtttgaaaacctttgttgcttcaactgcttgttgccaaccagcatagagatcttcccgttcttcttcaggcatttctggttcgaaacgttgcccaactgagaaaatatgcgccaattcgtctgtatcttgccagaaaccaactgctaaaccagccaaaaatgcagcccccattgcagttgtttctaaattagctgccttttcaatcgagctattcaaaatatctgcttggaattgcattaaatagttgttgtttgcagcaccaccatcaacgcggagcactttgatatcaatgccagtatctttttgcatggtttgaacgacatcccgagtttgataagctaatgattgcagtgttgccttaataacgtcttgtcggttcgtcccacgcgtaatccctagaattgaaccacgtgcttctgagtcccagtatggtgcacccaaacctgtaaaggcaggcacaacataaacttcatttaaactggttgaagccttagcggctgcttctgaatctgatgatttttcaaccagttgcatactatcacgcaaccattgaatggctgaaccagcaacgaagactgagccttcaagtgcatagttgactttaccattgattgaataaccaattgtcgttagcaagttgttttctgacattgttggtttttcgccagtattcatcacaataaatgaacctgtcccataggtgttcttaaccatccctggttggagagctaattgaccaaataatgcggcttgttgatcccctgccatccctgaaattggtaccgtgctaccatagaaatgataaggtgctgtttcaccataaatttcagagtttgaccgaacattaggtaacatggcccgtggaatgtttaaaatcttgaggatttcgtcgtcccaatccaaatcgtgaatgttaaacaacattgttcgacttgcatttgtatagtcggtaacgtgtgaagcgccacctgttaacttccatgtaatccaagtatcgatggttccaaagaggagttcgcccttttcggctcgttcttgtgcacctggcacttgatccaaaatccaacgaatcttagtcgctgagaagtaagcatcaattaatagccccgtcttttgatggaataattcttcatgcccatctttcttcaattgttcggcaatgtcatttgtttgtcttgattgccaaacaaccgcattataaattggtaaaccagtttccttatcccaaataatagttgtttcacgttgattagtaatcccaatccccgcgatttgatggggttgaatccccgatgatataaaagcgtttgcaatcgtcgataaaacagcgttccaaatttcgtttgcattatgttctacccagcccggttcggggaagtactgggggaattcacgctgtgcatcggcgactttttgaccattgtgatcaaaaatgattgaacgagtactggttgttccctcatcaatcgccaaaatgtatttttcagtcatcttaatcctcctttaacaacaatgttaggaaaacgtttcctcgaaaactattatagattaccgatgtccaaaaagaaagcgttttacccaaattaaattttacacaatttaacatccttaccaattcggcatttgtagcacatccaaaattaaaaaacgggtcaataatctcagatcaacactaattaaagtccttcatctgaatcattaaacccgtttttttacttaaatcgttgcagttattttagtatataattcaccgttcatcttgctgagcgaaaccttttcgttcttttcgtttgaaaataacacgatatagattcggccaccgtggctaaatccgttcgacacattccagcctgacaaataaccacgattaacaatgagtgctggatcattgtaaaagcccattccatagtgggacgtactccctggttggaacatttgagccttactctgttcattaattaattttccagtccacaacgcgcggtcaaaacggtacatatcagtcgccgtcatatacatatctccgacccctggtagttgcgtgaaattggggagttgtcccgcagcgccatttgccagatagccaatggaagccgctggtaatcgcgaatattgatccgtcatgaaaccagtgtgcgccattttacttggttttagaattttttcttttagatacgttttgtaatcttgatgactcactttttccaaaaccttcgtcagcacaatatagttcgcatccatatagtgccacttgcccggttgttccttaatcccatttttaataatttcttcgattaattggtcgagagtcttcgtctgattaccttgattccgaccgacaatgcctgatgtatgatgtaaaaaatcagtcagtttaatctgctgcccattcggaaagtccgggaggtaccgactgattggatcgttgacgtttagctttccttgttcttgtaactgcaataaactcgttgcaatcaacgctttttcagttgaaccaatcacatatagcgtatctggcgtattcaccaactgcttggcccgattagcactgccgtaccccttatccaacaaaacttgcttatcgcggacaattaacgcggtacctgaaaagccaatttgctttaagtagtcatctaacgcttgttctgcaacaattgtcggttggctttctgctttaagtcgttcttcctttgctttagcagcagcgactttttgtgattcgcgctgtttctttgcttcttgcgcttgtcgttggcgcttaatcttggcttgttgttgcgcgatttttacttctcgttggtgatgttgtcgctgaaccacaattccgcccgctaccagaccgaatatgaccagaataccaatgacaccaccaatttgacgccctttttttgacatcaactgtccctccgaaatttctaatctatccattaatttattacaatattaatgtacaatacgcttttggatttgaacagtgacattattgtcatctaaccacacgcaaaaaagcggtcgcgacaaaaaatgtcgtgaccgcttttttggaaccagacgttcttatttaactaataaaacattcgttgcagcatgggcactaacatattgggcaaccgatcccatcatcattcgttcaataacccctttccccgtaatccccaacatgattaaatcaatcccatattcttcaggaatgcgaatcgcaatttcttttttcggtgagccgacttccagaatcggggtgaccttcgttagcccatgattattcgcgtaacgaatattagccgctagttgctccttcacacgatctttttccatcgccgtcatcttggcatagacactagcgtccggtgaaacatagactgtacttggaataatgtgagccacataaagctcagcatcatttcttttcgcaacttcaacagcttccataaatgccttgttcgctaagtcagatccatcgaccccgactaaaattttcttatacgttgtaatcatttagcaacaccctcctattaatgaaatgaatgcgaatcctaattatatgttcatcatactgaacccaataggaccttgacaatttaactgcctaaacaaaagacatatagttaatagctatagtaccgtcgatggtgcacgaattcgagttaaagaattggcatctctaaaaagcctaatatatactgaccctaagttaattaacgaaagcacttactagctatctcatgcactcatttctaaatcaatcaacttaaataataatttgaaaaagaaaggactgtcacatatggatattgtcataaccggtgggacatctgggattggctatcgcattgccaaagatctcattgcagaaggccatcaagtcattatcattggacaggatgcggaaaaaggccgggcttctgtggcccaacttggaaaagcggccttttttatccaagccgatttagcgaccaaatcaggacgcaaccaagcactggcaagcatcaaatataaagtggataaaatacacgttctagtgtacactgccggtgttttccccagctcagcagaagaaaatattaaggctaatttagtcccccattatcagctaacaatgggcttagcagaccgattaactggcggtcgcgtccttatcgtaaccggtgatccgcaaatcattcaacaactcagcatttgcgaagaacaggagaatactttacaacgtgcaaggtcgttattaacccataaagctttattaaccctctttctcagttatcttctggccgaaaaagagattacggtcaattcatttttcccaggaaatgtcacggatgagctaccgcattattctcaaacattgctgcatactgaagtgccagttggaaaatacttagcactccatcccgatctaacgcagagcaccggtaatttttttgataatgatcgcaacttggtgttactcaatgctcggcaatacaactatgataatgccgaaaagcatttgttacagtatttaacagagtaattgagactataaaattgcttatcattagtggcaacatgagaatattattttccactaaactaaaaaaggacctgagacagtttttgtctcaggtccttacttatttgattgaattgattgtataaaaaaaccccgcggatgcggggcacaaatattaaagtttaacgatgtttgttgcttgaggaccgcggtcgctgtcttcaacatcaaatgatactgcttggccttcgtctaatgacttgtaaccgtcaccttggatagctgagaagtgagcaaatacgtctttgccgtcttcaccagtgataaaaccaaaacctttgtctgcgttaaaccattttactgtgccgttgttcataataatttcctcctgatacatatcaatgtacgttttttgttgcaataaattattgataggtaaaagaggaaggtattgtgcatccaaaactcaaattacgtttcaaaatttgattacttgaacagtatagcatggcattttctaattagcaacccgcatcccaaaactatcgactaaatcgatcgcaattcattcgcaaaaggctattaaaataggctttaaagcgcataaactttttatttaaatatttaatttctaatcattttcgaaccgttttgtaaactttgcctcgctaagtgccatcaattcctcaggctcaatttcatatttcgaacagataatgagcagttgatcgaagcaatcggctaactcctcttttaagttagctcgcttttcagcgtcgtttttaactttttcacctgggtgatcacgcccaagttcaatcgttctaacggcccgtgataattccccaagttcttcactcaagaagttcaaccgaattaatggtgaaaatcgataccaattccgttgttgataaaaatcaactaaccatgtttgatgcgcttttaaataatcttgcattttacattcactccatcattaaaaaaacacctaacctcgcaagcaatgtgcgaaattagatgtctccaagaattattgaatgtcacaggcgagattcgaactcgcgacctacggtttagaagaccgttgctctatccagctgagctactatgacctcattgattgacggtttttgctgtcagaataccacacaacatgctatattataagcaattgaagtagtcactgtcaattaaaattcgcagaaatgagggaaaaacatgcaattaaatcagtttgcacgcttaactaaatctcaatctgaacaaatcacggaattacagcgtattcatttactcccaaaggatttcacccagctccccttccaagtccttgcccaagatatttttcaacggctgttcccagaagcacatagtcaatcaacccagagcgggcaacttagtttattacaagccacaaccgaattaaatctaaccgcctaccttgaaaccattgatacttcattcgatcaagttgtcttctataatgtcgccctccaactcttgggttttgaaatgacaaccgattttgaacttgatcaacccactgcttttatggccgccacaaaactcccatttatcgatcaagcggcatttgatcagaccactttcatcgaagccctttatctcctattaacgacgcgtagccaaactgggttactttatctggatcaattggctaaccgtggtttttttgcagactggcaaagtgatcagccccaatttctcatcttcaatggtaaggtacaacccgttttcgataccagccatttaattcgagaagtcgtttatgttgaatcgagcctagatactgatcaagacggccaacgcgacttattagaaacgactatcttcagaccacgcgaaactgaagcgggcttaaaaattccggcactctacactgccagtccttactataaggggattaacgacgtcgatgctgatttgcacaatgttgatactacagttgcgactaaacccgttcaacaaccaaacttagctgatttaacccaaacgccaaccactgcaccgcttcctcaacctcgcgccgttaatggcacaagtatgacaactgaattaaacgcaacagatgacagcaattacagtttaaatgattactttctggcgcgcggatttgcgaacgtttacgctggcggcattggcacacgcggttccgacggcgtccggacttgtggctcacctgaagaaacagcttcaaccacggctatcatcgagtggttagccggtaatcgacgagctttcaccaaccgcaccgatggcattgaaattaaagcttggtggtgtaatcaccaagttgcaatgactggtaaatcctaccttggtactttagccactgctgctgcaacaactggcgttgaaggtctgagaaccattgtagctgaagccgccatttccagttggtacgattactaccgcgaaaatggcttagtggtcgccccaattgattgtcagggtgaagatgccgatgtcttagcgaagttgtgccaaacccgccaaaaagatgccgctgatcatgcgctctctggcactttcttcgccgaccaactcaaagccctgcaagaaggtcaagatcgcatcacaggcaattacaacgccttctgggcagcccgtaactatcgtgacaatctcgccaacctgaattgcgatgtcatcttagtccacggattaaatgattggaacgttaaactacaaaatgccggcgccttgtgggatttattgcgcgatcaaccggttaataagaagcttttcttacaccaaggtgaacatatctatatgaataacattcagtcgatcgatttcaccgatatgatgaacttatggttcacgcatcaattactcggcgttgagaatcaggctgtcacaaaattaccggctgttacaattcaagacaacgcacaagaagccacttggacgacccaggcggattggctagccctcgacaatccaactacgactttctggctaaacgaacaaacattaagcactaatgctaccgaaaatgccccactgacgacttttaaagatgacggtgttgcggcctttagagcccaaaaaatcagtacagccgcttggcaagatgccttaatcgcagatcaatcaagtttcactggcaaccggttgcgtttcttaggctccccgcttaccgaaccgctcattattgatggtcgaattcagtttagaacaagggtcgctgtcaatgccgaacgtgggctattgagcgtgctggttattgactatggtcaattcaaccgtttaggcaccacacctgctgtattagctgctaaaggccaacaactcggctatcagtggcgctatgatgatttaaaggaatttaagctcaatcgaccaagcaattatcaagtcatcactaaaggacacatcaatctccaaaatcgccacaatagttatcaaaccgacgccgtcaccccaaacgaattctatgatatcacgctagacctacaacccacccattatgatttaacagcgggacatcaactcggtctattagtctacgcgactgatatgggaatgacgattcgtgaagagcaagcattcgtttaccaagtcgacttggctgctagccaactgattgtcccccatctaaatgattaataaggagtctttttataatgtcaaatctcatcacctgtcgtcaaaccctctccatcagtaaccatcgcgtcttcgtcaatgatttgaacgaacatgaaacggtctatggcggacgcttgcttgaactcttggatggttcggcgtccatttcagctagccgcttagcgcgcgtcgaaaccgtcaccgccagcatcgaccaactgaacttcattgaaccattcaaaatgcaagattccttgtgcatcgaaagttacgttgccggtgtcggcacccgttccattgaaatctttactaagattatcggtgaacatctcaagaccggcgaacgattcctcgggctaactgccttcttaacctttgtcacaatggaaaaaggtccggcccttcctaacattcaacccgaatcaccggaagaacggttcatctgtgccggttatgaggaacgaaaagcccaccgtctcgcaaattttcaaagtcaaaaacatttcaatcaaaatatcagtaccgattatccatggaacggtcaataacgaacaaaagaggtgtcgattatcatcatcggcacctctttttatttatccgccatttattgacataggagcagtataaattaagaaatctgttaaaacagagaaaagactagataaatccgatatttcgtcaggtaatggtactgcaacggcatctttggataaatctggatcgtaatgataaatatgcatatgattctgaggaattttaactcgatctggatttaaatgagtaccattattaatatcgaccctgatgagatgttcattagaatctttgaatcggatatgcagactaaatctgctatcatcaattgggtttctatatcgatgtaatttatattggatatgatatttgaaatctataactggggtatcatctttaatttttccaataagagggatttcgttagggatttctttttggcaatttttaagagaatttattaagtttttgacttcactatctgtcaacatattcatgtccaagagatattctccaatcttagaattttaattccccagctatgaatcgaacatagctaaactcaccagagtggggaagatacttaatttccggtttgataatggtacccagcaggaagaggttcgccaggggataatctacgggaatgtccttttcgcgttgcccaagtatagccatcttcaatagcccaacgtataccagtggcattgttagtggatgcaggagcgttgttggtagcagcagcttgagcggatgcggcctgagcagcgtttgcactttcttgtcgggtactttctgcagcagcttgagcagcggcgttgctttctgaaattgaatttgattcagcgacacgttgtgccgattccgaactagctcttgcagctgattcacttgcggctacagattctgatgttttttttgcttcttcagattctcttgattcggcagctttcctataactttcactttctgattttgaagatgcaatagattctgatttagcaatgctttccgctgaattagaatgctttttactgtctgtaaccgcttcgtcactttgctgtgcgttttggctagaagctgtactaggtgaattagctgcagcaccaaatataaataaaataacagtcatcagagcgatccaacgagttcgcaatatttttgacttgttagtaggtaattcatacggtggttttctttttaatacaaatttgtagagagcaatatacaatacataaaataagccgataaacgcaaataaattaaataaatttaatgtgaaaagcaaaataattattaaaataatagcaattgcggttagccaatttttatgaggttttttcggattaggcgccatattgttggcatccgatctactcctagtcgtacttttattcttagcagaatagtcattagtgtacgaaatacccgtcccaggtatagaactagtcgtacgcgttccgccattagctttttttgtatatctaaatccttttaccccagcgctccaaccgatccccgatttgctaaagtttactctaaagcgcttacctaaatttacactttttctgtatctccaacccaatttaacccctccaagtaatatcagcttttaatgtcttcaggttttggacgaattcaaaataattatgccgctaattagtccccagccacgaatcgaacgcggctgtctcgccagagtggggatatttctctttatgttaataatcgtttaaatttaaagtattagcagtgatatcttgcattggaatagtgatcttattcttttttggattgacagtttggtcataatccgaaatggctagagggtcataaaggcttaaattaatatcttttgaattattatctaacttatatccagtttcaattaaagtatgcatttctttcccaggttgtagttcattttcttgttgatctgcaatgtcattaattctgttttcctcatttacttggtcagtggtaaaggtacctgaaatatcttggctatctgataatttaacattttgtgaaccgtctgagttcaattgatgtgcaacaatgttgatgttgaataaatcaccaatgttcatggatttttttgaagtgtttttatatgtaacgtctaacataatagagtcctcattgttatgagtagtatctttaaaaggtatggctttgttaattttaattgtgccattaggaccatagaaagtttgggctcttgcgtagtatttataactcttttgctgtgatttattatcagattgcgcactgctattacttgaagtggcacacccagcaagtaataatcccatcgttaaggctcctaataaggctattatttttttcatacttgttcctcagttcgtaaaatcagcttttagcgtcatcagtatttggacgaaatacatagtaaatccctaactgtgaatcgaacctagcgtctcaccagagtgggttatttctttttaaatacattgccgcaatccaaacaatggtatcgcttagttttattactttttaaaccgccagtgactaccatagaagtaccaccggtcataacggcggcagctatctttgcgccagatttctttttcttaactttggtagtggttttatatttagttttagtatttgcaattgttagtggatgcaaaggatttaaatttggagtaattcttgtttttgaagttgttttactcttagttgatttaacgtttacttgttcgccaattagttgaatgttagaagatttacagcgcggacagtatagatcaccccaatgatgttttattttaggttcagaactgtactgttttgaatctacggctgaaaaactagatgtgttgggtttcgaattagtgctaagccattttgatatagtagttccagcactgggattggtaccgacgaaaagccaaatacatataaagagtatgctccccataaaggggatgtgaataaaaatcatattaattaaaccgacaattacaccgacgaaaagaccaagtgtaaaaccagaagtggaatcgcctttccaaaatttattgggggcctttttgtatttgaattcagttaggtcatcttgttcattctctggataacgcataaatatatttgaatcattttctttatatttattttttaggtagagaaatgcaaggtcatttatttcatttctttttatgtttaagtcattagaaatatcctgagtgcaattttggcaaattaaaatatcatcgactaatcttgttttgctttttgatattaagtcgttatggcagatggcacatttgttaatcactttaagaactcctttatgtacatctacggcttttaaagtcatcagtatttggactctaatgttagttggaagcatccacgatttgaatgccgtttgcaaaattaataagttgattattaacttccatcacagttccatatttgacgcgataataatttaaggtttcttctaaaaattcttttgtaacatcaaggctatcggcaagttcatattcactagttgagcgccagtacgcgttaattagtgaatttaacgggatgacagattcataagcaatccgtcttgctttatattcctgcttcttttcagcaatagatgcttgaccaacgatattaccgatagttgtttcttgatgtgctagttcctctactaaagcctgtgcttgtatttgaataggcttatttgcattgattaaaatagttttcccgacgcaaagaccgtctaatttatcaggcatatctttttcatatttaacggaatattgagtttcgatagatgctgaaagtgtatctaatctattcatgtaattcacatcacttgtttttagattttttgaccatttcgatatagtctagtatttttgccatatcttcgtcagttgcatcaggttcaatgtgtgcggcaattaacgtagcattatcactgggtgcaatatttctattttcagttttaccaagaaggtagtcggtagatacattaaaaatatccgaaactcgattaagttcatcacttgaaatctttcgtgtaccgttaataattctacttaatgcactattatcgattttaagtttaaaagctacttctttttgagtgtaattactttcatcaattaaattagcaatgcgttttcgaagaatatcttcgacagtatttttcattgttcaccctcctttttgcgctttacgcaataattgtatcaaaaattgtgatttcaagctctatatttgtgaaattagcaaaataatgttgacattgtgattttcacaatgtaaactatgattatagtaattgtgattttagcaaaaatggtggtgagtaaatgttaacggaaattgagaaattgaatttgaatagtatccgaaagcttagagaaaaaaatggattaactaaatctgatatggctaagagactgggctttaagacaacagaaaagtattctagacgagaaaatggtgaatacaattttcaagttgatgaattaccaattatggcagcaattttcaaagtttcgatggaaaaattttttagctagttcgttgtgattatcacaattaaaggaggtgattacatgtcaatcgacaaaatgaaacgagatattctaaatagcccaatggcggaggttcgaggtaccgaacgaatcaagcaaatgttagaacgccatgatgagttgttcattaagcgtttatatcaattgatggtagaagacgaagaaatcgcaatgatggggtagaaccatcaagcatgtctaaatcatatgacaatcgtcattcactattaagaagggaaaatgataattatgaatcaagctaagtttgatcgaaagatagacattagtcgagtctttggaacaacgataaaagagggaaagttagttcaaaaagaaatcgctaaacgaatgcatgttacgccaagcgctatcgctcatttgaaaaaaggggatatgccacttcaatttgaaaatattgaagcgttgatgaaggcaactggaaagcagaatcagtttttagcaatgcaagttgctaatcaaatggttggtatcacaacgccagttattgatggcgataagataatgaaagagccgctagctatggctgtaaagaccatgcccgaactatcacaggcgatggcaagtatccaagaatcaatggatgaaatgaccattccaagtgatcaacgaagaaatgagaacttcaaagaccctgagaaacttgttaatgagtgttttgacgctgttttatatttgatgaacctcatcgcttatgtatgtaaatcttttgagttttctatgcaagacatgcttaaagcgcgagttaaacgctggattatgaagggaattgtgaaaggagccgattaaatgggcaatcaacagcttgagcgtattacgctaacttattccgaagcagcgaaaaccattagggtatcagctgatgctattccgttgttagttgaagcaggacttattaaaccgttacgttttaagcggcccaagatatcaacttacgagttgaaaagatttgtaattgaaaccgcagcagctggtattgatatcgaggcaacgttagagcaattgagattagacaaaaaaactaaaaaaatgcaggaggttggatagatgaaatctttagacaaggtagttttaggagtttttgttacatcactatttgcaatcggatttggcccttcaatggtaatcatttgtgcaatttcgggcgggtatctgctaagaagcattaacacatacagcacgaaattattcggcgaggaggaagaagatggtttggatgttaacgacgatgacaatcttaatactactggcattgatagacattaaactcaatttggacataaaaaaagccgctgatgctggcacatcaacggcggattaataactcaataaagaatttatacaagtattatagcataaaaaattaaatgtgaagaggtaatagatatggttacaacaactgaacttcaaacacaggatttagaatttccaattgattttacaccggccaaaatcactatcggcaattttgatgagatgaaacaaaagctgacagattatgcggcaacctataaagatatcgttattactgaacagacattcaaagacgataagaaggttcgttctcaaatgcgatcattgaaaaagcaaattaatgaccggcgtattgctattaagaaggacattaacaagccgctagatgaatttgaaagcaatgttaaagaactgacaacaattctcgacaatgtgattgatccgattgataaaggcatcaagttctatgatcaagcggttaaagacaaaaagaagcaacatgtgattcagctagtaacttacttaactgatcaaaatggattaactgtggataacatccaatttaacaataaatggttaaacactacatcgacagataagaacgttaccgaagaagtgaatgctcagattgaagcaattaaagctgaacaaacgcgtttagaaggtgagcggctaatcattacgaactatgccaaagcagtcgaattagacgcgtctggatggcttgcaatgatcaatgatggtaagtcagcagcggaagttatgaagttaatggataaagcccgagaagaagctaaacgtaaggctgtagatgaagctgaaaggcaaaagaaacaagccgaatatgatgctgcgatggcaaaacttgatgaagataaagcaaaagaaaatacggttgaaattgcaggccgcaaagttgatccagatactggtgaaatcattaagccggtatcacaggaacaatcagaagcacaacgaagctacagagctaaacctaagatttacaacgtgctgttaaaactaaataacatcactggcccacaaagccagatgcttaaagattttcttgatgataataatatcaactatgaagtcaaggaggcatagacatggaagtaacgattgctaaacgtaaaaaaataaagataccgattcttgtaacgggtgcaagtggctcaggtaaaactgttagttcattgctcatcgctaaagggattgttgagaaaatgtatcctgacttaccttcagaagatcaatggttgaagatagcagttatcgacactgagcataatcgcgctaagtattatgctgattcagaaattggtggtagtcaggttggtgagttcttgcacgctgactttaagccaccatacaacgccagtgagttatctattggtattagccaactaaaagaaaaaagagtcgaggtgattatcctagattcgctaacacacatgtggtccggcgatggtgggatacagaatcaggttgataatcttaataaacacagttctaaaaatagcatgcttgcatggggcaaagttaagcctgaaattgaaaagttgttcaaattaatcactgatagttcagtattcatgatatgtactgcacgtagcaaggctggctatgatatggaaaagaatgaagcgggcaaggttatccctgtaaagattggcttaaaaccggaaatccgagatggctgggaatatgaatttgctattaactttaatattaaccaagaccactctgctgaagcaatcaaagataataccaatatgtttaatgactttggagtgatcaatgaagagaccgggcatcgtatttatgaatggtctagccaaggcattgatatgaataaaaaacgaaacgaattgatcttacgaattgaagagttggctaaaacaacagagcttcgaaccgctaaatttaaaggcgtatatggagcactaaataaggctccacttaacgaatggccatatagctatttagtgacgatggttgcagaacttgaaaagctaccgaatggtgagccagtacaagaaatggtacgagaaacagaagaaggcaatgcatttgcacaggggtgattaggtgctaccaaggatggtaaggattcaaggcgatgaagtaacttttaagtttgatgaaatgccaagcttggatcgattaaaagtattatacgggggcaacctgagtaaggttgtcgctgatattgagtttattgacccacgtcgtttttcaattaagcaacgtaaactattcttcgcaattttagaagacatcttccgatggtctggtaacagcacagaggtgctaaaagattacttctacgcggaatatagcaccaaaacttatggcgggttgatcagctttaaaaatgactcaacaacaactatgagcgaagcaacattgatgcttgaacttgttattgattttgttcttcaaaatgacgtgccaataaacaaagcattctatcttttaccaaaagacgaagcttactggggttattactgctgtaagaatcgtaagtgtatggagtgtggtcgtaaggccgacattcatcacgtagatgctttgggaatgggaagcaatagaactaaggcaaaacatttaaaacatcattttatggcactgtgtcgttttcatcacgttgaaattgaacagataggacgaccagcatttgctaagaagtaccatatgccggttgatggcgtgaagttagatttagaaacactcaaaaacttaaatatacaaggagattattcaaatgataaatagagtcatacttgtcggtcgtctcacacgagatgtcgatttaaagtatacccaatcagggacagcagttgggcagttcaatatggcagttaatcgacaatatacgaacgctaatggtgatcgtgaagcagactttatcaactgtgtcatctggcgtaaatcagcggaaaacttcgctaatttcactaagaaaggctcactagtcggagttgatggtcgtctacaaacgagaaattatgaaaaccaacaaggtcaacgggtatacgtaaccgaagtggtcgttgataacttctcattgttagaatcacggacaacaacggatcaacggcaaagtgatggtgcaagccaaaactttaacagcaatcaaagtaatggtagccaacaatctggatttaccagccctcaacaatcgggtaatacactggctgctaataacactcaagccgatccatttgtaaataatggacaagcaattgatatttcagatgatgatctaccattctaaataattagacattgccgggaggtgaagccttggctaggccaataaaaaaaggtattgattactttccgttagatgttgattttttgcgagatataaagattcgaaaagttatgcgtgcttgtggatcagcagctccaacaatacttatctgcctgctcggtaatatctatcgcgacgaagggtattacatgaagtgggacgaagatactcgtttcctagtggctgacgatgttggtactagtgaagcgtcagtagatgaagttgtaaagaaatccatacaggttggtatattcgattctaaactttatgatcagcaccaaattttgacatcacatggtattcaagaacgctataagaaagcagcatatcaaaaatcagatagcagtattgataataaatatgacctacttaacgttaatcatattgataacggagtttccaatagtggaaacccagtaaatcatgccgagagtacacaaagtaaagtaaatgaaagtaaagaaaaggaaagtaaaggaaataatactagcccttctacaccagaaggcaggattcaagaagaatttgcaatcctctgggggatgcacccacgtaaagtcggtgatcaagttgcagcgcttgatacttacaagaatgatgtcttgctgaaagatattactttcgatcaagttaaagcaaagattgaggcatacaaaaaacaaattgaattaaatggcacgcagacgacttatatcaagacagctggtaagtggtttacggaacgttgttggaataacgaatatgacacaacaccacctaaagcacctaaaaagccatctgccagacaagaacccataccaaaatgggcacagcctgattaccaagcaccggcacaggaacgaacgccggaacaagaagctcgggataaggcacagattgaagcagcacttaaaaaattgaaagaaggcagggatgttaatgccagctaaagtaggcgacctcgttagttgtccgccgcaggtagttttaggccggacgcttgctaaaggcggacagtcgtacgttgtgggcgttaagcaactgaagtatggcaatatagcacgccaaattaacattgttcaagataaacaaggtaaccgcactgagtattttgattcagattgtgggttagtacaggaggcgaaatagatggtctcagcagcgatgaacgaattatatgagttagaagataagtatggcggaatgatgcggatccctgacgacgaattatctagagttagaaatgcgcttgatactccagagggcgatcaaactaaagtacgcagaaaaagaggacgtccaaaagggtcaggcaagacatctaaacgtgtggtagataatgttgcgaagattgaagtgctctatgcaagagggatttctgttcaagacatctgtaagcaacttgacctatctaaggcacatgtacatcagctagttagaagatttggacttaacactaaatacaattaccaagattaccgatataaagtttcaaacggaaatgaagaacattattttagaaatattgaacttttagctgattatttttggctaaatagttatcgagctatgaagaagtttcaacagaatggacagattaacggcttcaaacttgaagttggtaagttccgagtaaagggagagggcaatgatgcaaacaaagatgacaccagccgatagattgagtgagctggttagcgataataacattcctgtaacggcattgtttgatgtaaaaagtcgaattaatgattggttagcagctggtggaaacctcaacgatgaatatatgtggatgcaagttcggtatatcgagaacattgcaaaacgcatgggagaacttggaggtagtctgtgatgacaattggcacacctgtaaaaatcaaagattatagcgtgcatgctgttgtgaccaaaagcactagcgatggagtgacaatcagggatgcaaacggcagagagtatttctgcttcgagtcagagttagttatttcaaggaaagaactggttcaaaaaatgcaactgttgccattttggaaatagttcaaaagtaaatcaattaaaaagaccgcgttagcagtcgaaggaggattaacatgcaaattaaaccaattaccaatagcaaacagtggttagatgccatttaccgtggggcaagagctaagcgtatggatgaacaacagttatcaaagtcctttgtgttgctgctgctgagaacgcagtacatgcacacttggctgtattatctgccaataagaggccgcaagaacaaaggaaaccgactgcacaagttggcagctgattatttctattcattgagcggccctgatcgcatcaagcttgttaatgattgttttgagattaattggggcagccgcagcttgaaaacaatttatcaatcaatgctagctgatgacgacttaattaaatattaggaggattaacatgcgagagattaagtttagggcgtggcacaaaaatagaaagacgtttcttgatttttattgggcagtagacaagttagggagaactttctcgatattagacaagtatgtgtatgacgagtttacgaacgaagtcgaactcatgcagtacaccggcttgaaggatatgaatggcgttgagatttatgaaaaggatattctgcaagacccagatgacgaaggattctgctacgaagttgaatacgattatggcagatttagttgtggcgataacgatttaatcgattgtcttgggtgtaatgttgttggcaacagatttgataatccggaattgttggaggcggactaatgttttgggatattttctggtggctgtttacgtcacagggcgagacgtttattaaagcatcaatcatcatcttgatttttgtgttattcgtttggggatatgttgagatggaaaaggagggcgactaatgcaaagtccgacagcgttaaacaagcgcggcaaaaaaatagaagcggatggctttaaatttgattcaaaaaaagagtttgacttttacaatcgatttgttaaggattgcgggctaccgtttgaagttcacccgcgtttcattgttgaaccaaaacaagaaatccaaggcggcaatatttcatcaatcgcatatacgccggactttattatcttcgatccatccggtaattggctgcacgtgtatgatgtcaaaaacagccttgggccttatgggattgatcaatcgaacaaacttagattccggttgtttgctatgaggtatggtcatccggttgaagctgtggttgttcggactaatgacttcaaagttattacgcaaggtgttactaagccgcttaatgacaaagagccgttgatcaaacgggacttcaactacagctgggttgaagctaccaattattaggagatggctacatgacaattgaacaagaattattcaagcgattctttgaatggacattcgaagaccacgcgcaagatgtagttcgaaccgtagtctggatgaatagccacatggtgatgattaaaagagattatccaaaagagtatttggcttataaagcactaactaatcagcagattaatcaagttatatgtgaagtattactaccattttaaaaatataggaggataactaatgacagacaatcagattaaactacttgaagaactaaaatctatggtcatacacgataagaccgcttatccaatgttggcttttggctacgtgatcaaaaagaatgatagcacttatgacgaattatcacagcgagaggaatacgaggtaatgaaggcgttcggcgaatgggggcttagttgatgggcgaaaggaatattgttgaaattgtccgcgaaaacgtagttaggtatatggcagaagctgggatgaaaaaatttgatttagctatggttgtcggcggaaccgcgggaattcaaaggttaattgacggtggctcagttaacggaccaacgattgtgacacttcaaaaaatagctatggcacttggggtgaaaacgattgatttggttgaggattggagtgatgaagatgaatagcgctggtttaattacaatctaatttaggcacaaaaaaagccaccctggccggcgacttctacatacttattagttcgaatgactatattataacaaaataaaggggtatacgcatggtttcatttaatgagttatttccacaagtcgacgaaaaagcaacgattgataaagtaaagcatttctttaaagtacagttacccattatgcaacgctatagtcatagaaatgtgagtggtatcaagtcaccggtcattactgatatgccaaagggtggatccgtaaataatcaaatggaagagacgttgacccaaagactgtatgcagagcaagtagtagcacgttgccgtgaagctattgattgctgcgacgctattagtcagaagattctatggagtatctatgtaaaagaaaacactgtaacagcagctcagcttgaaagcgggtatggtgaaactcgattcagatattataagaatcgggcatgcctgcaatttgcagatgcattcatgattgaagacttgcacgagttcaagaaataaaaagtgcggtttttgtgcggattgtctgtggttattagccagatttccgtgataaattagtattatggattattagtaaagcgcgcttaaactgtgaccagtaatcaccggtggaaaacggtggtcgcgctgttgccaaaaatacaatctgttatacccggcaattagcgttaatcaaactttgttaggttaatcgacttcaattctaattgctggaagcgtggggttagcacgttgttgccgtggatgatcgcggacctaaccattcctagtagcttaaatagagcagcgcggaagtgcacctgcggtcacgattcgggttcgagtcccgactaggatattatcgcagcggcggaataggtaaagcgtctttacgccttaaaacggcaattgtgtggtgcaaatccacacctgcgatattgccagtgatggcacatacttcacctccaatagccctagcctttatggctggggttttgtattatgtacatattggagggcaaaatatgaaaatttttggattggaaataggtagttggtcggatttgttgagtgggtttgcaactttggcatcactatggtttttatattatcaagtgaagaaatcaagcgacgatacaaagaaggctattacagctcaacaaaaacaagtaaaggaagataaattatttaagttaaaggaagaagttttaagtatagcgccggattatcgttattttattaatgttacagagaataacttggctacatataataaccgtattaaaaaacgcgatataaaaaatatagcaacctatgaattatggtctataatgcgagaagtacaatcaaatatgacggattttcgatatactaaggaagaatttgatcataagatttcagatttaaaaactaaattagataaagttaatatattgtattcatcaagtgttataaacgaaaaagacttagtttataaggacaatataaccaagatgattcttagtttgaccattatgcaggtagttattagccagttcattagtataactagtattgttaatcatttttttgagtttgatagagataaagaaaatgcaatcgctaattttaaggttgataataatgtaataaatgaatccattaatacagaaggtgaattattttcatttaaagattgtaataaattaattgatgaagttttgaggtagcttaggctgtctttttttgtacataaaattaaaggagtgataggcattgtgaaactaatacattcaaagtacggctacgaaacacctgaatggacggcagcagatgcccgtttagagaagtggcttaaacagaagaagatagatgagaaacgtcgttcagataatgagcggcgtatttttgtgcagaaaaacaataagaaggagggcggtgctatgtaatgcaagatgaggcaaaaaaagactatttagcgggtatgaagtataaagacattgccgaaaagtatgatgtttcgattaatacggttaaatcgtggaagcaacgcaataactggcagcgaggcccaactcaaaaaggggtgcacacaaaaaataaaaagggtgcacacaaagttgataaggttgcgcccaaaatagtgaaggaattatctgctaatgatgggttaagcgatcaacagaaaatgttctgcttgtactatctgcaacgattcaatgccacgtgggcttatatgcaagcttatgacgttgattatcgtactgctaatgtaaatggccctaggttgctaggaaatgctagtgtgcgtgagcaaattgataagctgcgtaacgagattgctaacgacctattcgttacagctgatgacatcgctaaagagtatgccaagcaagcgttcgctgatattggcgattacgtagagttcggtggacaagaatcagctatccttgatgaagatgaacgagagctgctagacgataacggtaatccaattaaatcgcatagatcgtatgtcatgtttaaagataaggccaaggttgatacatctcttatcaaaacagtaaagatgggtaaagatggacctgttatcgaattatacgataagcaaaaagctttagactttctagtgaactatgtaggcgagaagcagtcgcttaaaggtcaactcatgcaggctcaaattgaccgcttgaagattcagaatggtgataacgatcctgatgaagatgacgacgatggtttcttagaggccattgacaagtcagcgaaggatgtgtggtctgatgagtaatgtatttaagtttacgccgttttccaagaagcagatgcaagttttgacgtggtggcgttatgagaaaacacgtgttaaagatgcaatcatatgcgatggttcagttcgtgcaggtaagacgcttatcatgtcactatcctacgttttgtgggcaatgactgagtttgaagaggaacagtttggtatggctggtaaaacaatcggttcattccggcgaaacgttgtgcgccctttggaacgaattctaaaagctaggggttaccgagttaaagataagcgttcggataacatcttagagattagcaagggtggcgttaccaacagcttctttatatttggtggtaaagatgaagcgtctcaagatctggttcaagggttaacagcagcgggtttcttttttgatgaagttgccttgatgcctgaatcatttgttaatcaagctacggcacgttgttctgttgaaggctcaaagctttggttcaatatgaatcctgagggtccgtatcactggttcaaaacagattggattgacaaaattgctgagaaaaatgctattcatattcactttacaatgaatgacaatccttcgctgagtgccaagattaaagcaggttacgagcgaaggtattccggcgtgttctatcagcgttatatccttggactgtgggtgctatctgaaggtgttatctacgacaactttgataggcaaacaatgtctgaagacatccctgatgatatgcatttcagcaagtattatgtgtcctgtgattatgggacgcttaatccgactgtattcttgctgtggggattaaatgacggtgtttggtattgcatcaaggagtattactattcagggcgtgagaccaagcatcagcggactgatgagcaatatgctaatgagttaataaagttcttagacggcattaaagcgcagattatcattgatccgtctgctgcgtcgtttatcactaagctaagaagtatgggcttcacggttgtcaaagcgcaaaatgatgtgctcgatggaatacgtgcaacgcagaccgcgcttaatatggggcagattaaattcagctcaacatgctctaacgtgtttaaagagtttgcatcttatatctgggatatcaaagcggagcaacgtggcgaagataaacctgtcaaagaacatgatcacagcatggatgcaatgcggtacttcgtattcatggttatttacaaaaatagaacagcaaaagtgtcagccaaaccggctggcctttttggttaggagggatattttgggatttccaattgatagagaactggctggggacgttaataatcctagccttgaactcttggattatgtgttacggaaacaagctaagaacaagcagcgctttgacaagttagaccgctattacaatggtaaacatgatgtgttaaatcgtcagctaaacgaaaacagtaagaataccaagatagttatcaatcatgctaaatacgtcactgatatggctgttggctttgtaactggtaatccatttagttataccgctgcacctgataagaatatcaaagcaattcaggactcatttgatgcaatggacattgtttcacacgacactgaattggagaaagacttatctgtattcggagtagcttacgagttgctatatctgaaagcaatcgacgatacgacaactgaagagcggattgaatcaattgatccgcgtggtgttgcattagtcaccgatgactcagtagaaaagaatcccttatttggtattcattatcaaaagaagttcgacttggacggtcgtgagaatggctatctagttaaggtatacactgctaaaggcgtgcttagttatcgaactgtttcaggtctgaggatgattactggtaatgttggtaaacctaagtataaggagcactattttggtggtgttccgattattgaatatcgaaacaacgaggaaaagcaaggcgactttgagcaagctatctctttaattgatgcatacaacatacttcaatccgatcgtgtgtcggataaagaagcgttcattgatgcgttgttggttgtatatggttttactgttgaaggcaatttaaaaaacggaatgcttgaggcaccaggtaaaggcaccgatggcgcggccgttgaatggttaactaaacaatttgatgagtcacagctacaagtattgatcaagtcattgcaagatgacattcacaaaattacgtacgtccccaatctaaatgatgaacagtttgccggtaacatctcgggtgaagctatgaagtataaactgtttggtctgttaaaccttatgagcatgaagtctcgttacttagttaaaggattgagacgacgtttagaattaatgcaaaacatcatgctgattaagtcccaagatgtcgatgtgaaaggcacgaagattgatatcacgcctaacattccggttaacttaacggatattattaacaatattcgtaatgcagacggcttcattccgcgtgaaatcacagtaagctggttgcctggagttgatgaccctgctgaagtagtaaagatgttggagaagcaaaaagcagatgacattgcacagaaccaaaaagctttgggccagccaagtaacagcgatttagatgataagccagacggcaaaggaggttatcgtgatgatcaaggcgacgtttcaactaaacaaaaacaaccagataacgagttatcggattagtggtcatgctttgttcttgccaaagggcatggacattgtttgtgcaggcgtttcagcgctcacgattgctattactaatgagttacgaaacgatgttagcgtcgatcatgataacggctttatctcagttggcgatattcaatccagtttagtcaacacaacgctcactcatacgctactatcggggctacgaagcattgcggaacaatatccggataacttaacggtagaacagttaactagcttagaggcgtaaacatggccgataaagacaagctaagctactgggaattgcgagcagctcgttcagaacaaaaactggcaaaaaatggcgatgagtatgaacgaaaagtgattacggcttacaatcaagcacaagagtatttatcgaaagctgttaatgatttatataagcgatatgatggccaaacttcaatgaccgaagctcaatctaacgcagcacttaatcaaacggtgccagccgctgaccttgttgcattgcaaaatatcgctaaatcaattaaagataaagaaaccaaaattaaggttcaagagtatctaaactgggtggccgctaagccaagaatcgctagaatggaagagctgaaagccaagtcttatattgtcgctaagcaattggcagatgttcagttagaacaatcgactgagtattacattaacgctattaaagatgcctatacagatgcatcagttgaagcaattattggtaaggcgcagtccgagactggtgtttatagtggtaaaacgactccaaaagtgaatcacgatactaatcaaatcgagtttgtgaaaccagatagtagaaaagcggttaagtcagaaaccgttgaatcttttagcgaattgtctactcatgaagttaaacaaatacttgatacgccttggctcggcagtaactactctaagcgaatctggaatgatactgatttgttagccaagaagttacaagaattgtttgctgtatctgaaatgactggtatgagccaacgtgaaatggctgataagattgctaaggaattcaatactggcatcggtgttgctagacgcttaatccgtactgaagctaatcacgtacacaatcaggctaagttagctggttggaaagcacatggcatcgaaaagtattctttagtggctgtgctagattttcggacttctcaaaaatgtagagatatcgacggtaaggtatttgacgttgataaagcaactgttaatgttaattttccaccgttgcatccttggtgccgaacggttgcggtcgcttggtttagttacgccaagtatggtggcaatcgaacggctaatgatcctattacgggagaaacttttaagctaagcgcggaagatacttaccgagattgggagcagatgttaattaataaacatggcaataaaaagttaatgagcgcgaagaaaaacgcaaaaaatagtaattgacctgtcaaatgtctttaaactgggcaaattaatagcgtgtgtgggctaagtgtttcacatctagagataagcattgtgtgtgggtcagagatgatgttcatgggatgcttattttttgtggaatgaattggtgtgcatgagctgcttaggaggaatttcaaatgaaacatgtcaaattatttccaaatgtcttaccaatgaagttacaactattcgctgatggcggagaaggtggacccggtgagggagaaggcgctgctggcggtaatggtggagaaggtggacaagacccaaatccaaaccaaattacttttaccgaccaatctgaactagatagctggtatgacaagaagtttgctaagtctgctgaaaagttaaaggaaggttggaaacaagaacaatcgcaacaaaaggcgtatgaagatatgacgccggatgaacaacacgaacacgacttggaacaacaacaatctgaattggcagatcgtgaacaaaaggtgactatcgctgaaaatcgagcaaacatcactcaaaaactagctgctgacggattaccagttggcttagttgctgcttttgaaccagcttttgctgatacagataatctagaagatctttataccaaagttgctagtggttaccgcgacacagttagggaagcagtcgataaaaagttggcaggctcatctgatgtacctggttcaaccggaggtggtggcggtggtagccaatctgttggtgaatcattagccgaacaacgcaatgctagtcaacaaacccaaaaatctatttgggataaaaaatattaggaggaactaattatgtacgtaggaaagaaagttacaatgtcagacatcatctttttagcaagtgaacactttatttcgttcactgaacaagttgatgaaaatacagtgggtgttattactgatgatttaggccacaaagttgtacctgctggcacagtattcccttcaaacgatggtaaagcaaaaggaattacgattcatgaagttaacgtatcaaacgggccacaaccagttggtttaattgttgaaggttggttattggcacaacgattgccagtaatgccaactgatgaagctatgaaagctatgacttcaattaagtggcgtgatgtcgaaaagaaaaatgaaccagctgaaacagataaataattagaatactggaggaacagacatgaaaaaacaattagttatgaatttacaacactttgcggacatcttagaagtgtttactaagaaagatattttagattacacacgaaaccgcgcttaccctgaaatgcttggtgacactttatttccatctcgtaagactcaatcgttagaattagatcagattaacgctggtagcatgacgccggttattgcatcagtatcagcatttgatagtgaagctgaaattggtagccgtgaagctagcgctcaaacgcttgaactagcgttgatcaaacgtaaaatgcaaatcaaagaaaaagatttgatcgcactacaaaatccacggacaccacaagaaggcgagtaccttcaaggacgtgtttataatgatattgatactttagttcaaggtgtccaagctcgtgctgaaaagatgacaatggaaatgctatctaccggtaaaattactatcaaaggtaatggcttagatgctaatttagactattcggttgacaagaaacaccaagctgcattatcaggcgctgaatcatggactaatgatgcaagtgatccgatcaaaaacttagaagactggtcagacagcctagatgttgcaccaactcgcgttttaacatcaaataaaattttgcgtatctttatgcgtcatcctaaagtgattgctgccattttcggtaaagattcaggtagaacaattgggatggccgatttggattccttcatgcaagctcatggattacctgttatccgcacctatgataacaagtacaaaacacaagataaaaacgggaaatatatctcggaacgctacttcccagaaaatagctttgtgatgatgaatgatgacttgcttggcgaaaaagtatgggggccaacgcctgaagaaatcgcattgacgggtgccggtgatattgaatcatcaatgattggtaatgtctatgccggcatttatcgttcaacgattgacccagtggggacatggactaaagcatcaggcttaatgattccatcattcgctgctgttgatgaagtattccaagcaaccattgatctaactaaataattggagtgattgttgtgagcgatgaaaaaagtaaacaattaactgcgttgaagcgtcttacatctgaagaggatagtgatgcggctttgattgctgacttgtacaacgatgcgatcactgaggttcttgattatactaatcgggataagatgcaagatggcatgtacgtctacgctaagaagattgctaaggttgcgttcaatcaacttgatgtcgagggcgagaccgctagaactgaaggcggagttgttcagaacttcgaagtaggaattcccgcaagtattcgttccaaattaaatcgttaccgaattgctaaagtgaggtctttatattgagactcaaacgaagcgatttagtagcggtttttttacggaaaagagtagtagggcatgacgatgagctgaatgagatcattacctatgatgatggtcaaaagctaatgatgaatgtccaacctgcatcagggcaagtcgcagccgaattgtacggtgagcgactacgttactttgccaacgccaagtatgtaggtaatgcaatcaaagaaaaccgtaatgagttagacggtatttgcttgaatgttgcatcggaagatgatcctgattaccggattgtagcaatcaacacttacagcaatcatctgaacatgactctagagaggattaagcaagatggtgaaagtagaagtaaaagggatgagccaactcaaagcgaaactcgatagactgcctaaggccatagaagatgccgtttgggatgcgaactttgatattgtcgaacttgctagagccgataccgtgcgcgagattcaatcttctaccaaacatgggagcggcgagaccgccggttcatacaaggatgaagttgttattaatagcaacgggcatgttgttggtcggatttggtctgataacccaacagcaatctaccgagagttaggtactggtcaagttgggcaagcgtcacctaaggagttacctgaaggagtcacgccagtatatcggcagaccccttggtttattcctgctgaagggttgcccgatttaaacgctctgtatggcatgccgttgattactatcaaaggtaagaagttctatcgaacaaatgggcaacctgccagacaagcactcatgcctgccattaaaggggcaaaacagcaagctcctgaaatctataaagctaatgtccagaaacaacttagaaagttgcgtggttaatttggagattattaatattaaacagcttgtggcaggtattctgtctaaacagacagatttaaactactgcgggacaagttatccagatgagttaactaagttccctgcagcaatctaccacaccgcacataagccgcattttatcgattccgataagcaggaactagaaactgattggactgtttccatcgatttgtttaacgatcatggttctcttacagaaatctcaaacaagttagtaaatgagcttgttaagttagggttttcttacacttcaggagaccagaatttagcaggcgtaaaacgtaccgctttagtattcaacgcgatggttgataaccaacgtagaatggtatttcaaaattaggaggaatttcaaatgaagttattaaaaactgatttacaaaaatttgcagaaacattcgtagaccctagtctgggtttacttaccaaagggacgaaactagcctttaaatctagttcagaaacagattttgtcgaagtagctgcagtcaagacagttccagatattgggtccgatccagaaaaagttgatgttacgtcactcgaagacggtaagaaaaaatctattgcaggcttgcaagattctactaacttagcttttggtgtcgtctacaaaggcaagaacttctatcaattgcttgataaacaaggcactgataaacaatatgattggaagattacttacccagatgggttaacggtaacgtttaaaggcgcattctcgcttaaattaggtaatgctgaagttaataagagcatggattacacaatcacggttgtggtttctgatgggcctgatattgcagccccaaaagcgtaacgggagtcacacttaataaaacaactttaagcttaaaggttggtgctgttgaaacactaaccgcgtccgtcactcccacggacgccattaataaagctggtaaatgggctagcgacaaaacttcaatcgttacagttgatcaacacgggaaaataactgctattgcagttggtacagctaaaattacatttaaaacagatgatggttcatttgttgcaacatgcacagtaactgttaccgcagcataaataatttattggaggaaacaaacatgacaaacggtaaacaatttaacttaggcggtctaatgttagacctacgattaaacggaaaggcaatcttaaacattgaaaagcgcttaggcacatcaatcatgtcactttatatgggtggcaatggtggggtagtattacccgccaccaacaagctattaatcgtattacaaggtgcaaatcaaactcacggtattactgataaagatatgattggtggtttcgaaaagtatctcgaagcaggcaacacaccaatggatttaaataatgtcattcaagaattattggatgaagctggttttttcggcaagaagaaggacgataccaagacagatggggaatcagtggaaacgactctagacggggaaccaacggaagttgcggatccagaagaaacactataacccaacctgaatttaaaactgtgaccgaattactctatggtatttatccatatgctgtagaaaatggcatcaaggctgacgagttttggcagatgacgtttgatgaaattatgattcacattactgcgacaattaaacatcacagaaccatgcttaaagagcgtgcggtaatggaccataaaacagcagaactcatggcgtttgccgtcaatgacccaagcaagatgccatctgttgaaaagcactacagctttatggatgacaatgcagaacgtcaaccagacacattaaataatgagcctgatcgaactgagccagaagaatggcaaagtgatcaggctattttactgcaacaggctatgtcagttagggctactaacgaacgaaaaaagaatgaataggaggtgagtgaatggagttagaaacgcttgaggtctatattgatgccaatctcagtcggattaatgagcaacttgaaaagatttatccggcttttgagaaggtgcttagcagagtcgaacagattactggtgcctcaatggataagactgaaaagtctatggacatcagcaagggcagtaataagttaattgatgaagtcaaaaagattaacgaaaacatgtccaaacagttcgataacatgtcaaaaaatgctgaatcatccatgagtaaaacaggcgatggcatggctaaaggcatggcctcatcaagagttaaggttggcaaagaagttgatcaactagtcaataatgttaattcaaagatggaccaagctagagcaatccaacaaaaggtctctttccttcaaaataagaaagctgttgctacctctagtgggaatccattagatgcacagaagtttgatgctcaggtggcatctgctgaagcacgaatgacacggtatcagaatcaagctaaagctcttgctgcagaaatgcagtcggagtttgacgctattccagcatcgttaaataagattgctcaaacaatggatcaaaacgaagctgctattaatcggttgaaagctaatattaagtctttacgggcagaacaagctgaagctgaaatgccaacaggtaactttactgacggttttggttcaaaagcaactgctaaatcatcaaaaattggtgatcaagccgctaaacaagaagcgaaaatggcgaagctaattgcacaaaatgactcacttggctcaacctatgcaaaagttgaagatagaagtagtgcattaaagggtgctttaggaaagctgaatactgagttagataaatcggcagtagctactaagcgaactaacaatagttttagttctatgaagaatcatctaagcgaattggggaataagttttctttcttaggaaacggatccaacaatttaaatagagtggcttcatcggctgaaaaaagtagaaattcaatgtctggtttagctagaacggttcgaatgcttggttcccaattagttgtatttaccttaatgtatcaaggaattatgatgttggcatccggactaggcagtgccttgatgaccaatgcccggtttgcagcatcatttaaccaaatcaaagttaatcttctaacggcattctatccaatctacacagcagcgttaccagcgattaatgcgcttatggatgtattggtaaaggcgactggttatattgcacaatttacctcagcactatttgggatgagtcgtggtgctgctaaacaaggtgcagcgggactttataatcaggttagagcaattaacgatacaggcagtgcatccaaagaagcatctaaacaagttagagaaaccaataaacagattactgcagccaataaaaaggcggctgaatctgctgcagcagcaaatgaggcttctcgtaaacagatgcaagaaactaaaaagaaagcacaagagttaaaaggcgctttgatgggctttgatgaaatcaatacgctctcatcagctgaagacaatcctgattattcttatgataaacaaaaacccgataaacaaccattgcaatctgctgattcacttgatgatatccctggtactaattttaatattcctgatggtgctcaattcggtggtgctatcgctgcagcaaatgagtttaaaaagatcctagctgatctatttaaacccatgcaagaagcgtggtataagtatgggaaaagggttatcgatgcttgggaatatgccctacgagaagtaggcggactaattaaagctatcggtaagtcatttatggaagtttggacaaatgggaccggtgctgtatttattggtaatatccttaaattattggccgatgttttaaatattattggtgatatagcgaaagcatttaaagatgcttggaatgatggtggacgaggaacaaaactaatccaaactatttttgatgcctttaactccatattgaacctcttacattctatcgcgacatcgtttagaagtgcttggaatgacggaacgggacaggctattgcaacaaatctccttgatatttttacgaatatttttaaaacaattgggaatttagcggatcaatttaataaagcttggaatgccggtaatgttggaaaatcaatattttcggatatcttgggtatagtaaatgttgtgttagatacgcttaaaaagatgactggtgcaacagcagattgggctaagaccttagattttagaccattgctaaattcgattgatgggttgctgaaagcaattcaaccattgactaaaaacattggtgatggtcttctttggttttataaaaatgttttacttccactcgctggatttacaatcactaaactaatacctgcctttttagacgcattatcgggtgcaataaagttattgaatggtatcatcgatgctttaaagcctgccggaaaatggctttttgatagtttcttaaagccaatggcgcaatggacaggtggagttatagtttcagttcttgaaggtgtcgggaaagcgcttggtgttgtgggtgattggataagcaagcattcggaaggtttttcaaattttgttattgctgttgcagcattcgctactgctttgaaggctatctcaatggttcaaacagccgttacggtcgttagtggaataatgtccgcattaagtggtattggtggcataacaggagcgctatcattgttaggctctggactaggcggtattgttacattgcttggtggaccatttacacttgcaattgcggctgcgattggcgttggtgttcttctctggaaaaactgggatactgtgaaagagaaggctggtcagcttggtaagtggattggtgaaaagtgggatggtattaagaaagtaacagagaaggtttggaatggaatcacgaagttccttaaaaaatggggtagtgatattctcatttttatggttactggaccagctgcgccttttatcttatttgggaaatacgtttctaaacattgggatgagatttctaaatcaacctctaaaatatggggaaatgtaaagacaacaataactaataaaacaaaggaagcctttaataatggcaagaaatactttggaaacctgaaagattcagcaatttctcattttgaaagcatcaaaaaatccgcgtctgataaatttgagaatattaaatcaacgatttcttcaaaagcgagcgctgctaaagacggcgctttacgcgcttggtcatcaatgagagataatactagtccgtactttagttctgttaagtcaactgcaaaaaacgcgtttgataacgtcgcaagttgggccggtaatctcggtggacgtatggcatctggattaagcaatggtattggtgctgttaaaaatgcagcacgtggaattgctaacgctattgttagcgtaattggatcggccgtaaacggtgtaattgatggcgtcaaatggattcttaatcatgtcggcgcgtctggagcggctggcggattacaccattggtcaattcctaacttcgcaacaggtggtacccatagaggcgggtcggcattggtcaatgaccaggctggttcaatatatcaagaagcttatcagttgcccactggaaaaatcggtatattccctaagcaacgaaatatcattgctaacatgccagcggggactaagattatgaatgcaacaaatacagccaagttaatgcaatcaaacattccgcattatgcttgggggattggtaattttacgtttcctagaataaacttcccagattttagcaatatgtttagcggtcttggcggcgcttggagttccgttgttgatactgcagaaagtatctttgacgacgtaacgcatccgggcagagttttagactatgcaattaataaattcacctcatattccgggttggaacatcctgcattagatgtagcacagggcagtgtcggtaagattaaagatggtgctttgggcatggtcaagaaagctttagaagagttttcacctgagccaactggcggcagtggtgttcaaagatgggccggtgtgatccgcaaggcattgactaaaaatggcttgccttcaaacggcacttataccaatgcatggttacgacaggttcaaacagaatctggcggtaatgaacatgcaatgggtggtaacgatggacttctagatggtaatgctcagggattgttacaagttaaacccggaacttttgctgcttataagtttcccggctacggcaacattatgaagggctatcataacgccttagctggtattcactatgctaaggcgcgttatggttctgatatgttaggagttatcgggcgtggtcatggttacgccaatggtggtccaatctttaagcacggactttatgagatgggtgaaggcaataatcaagaaatggtgttgcctttaaccaatagatctcgtgcttgggaattaatgcaacaagcatcagagatgatgggctttggtcaacttcaattgcctgaagtattgtctcgagaagataacttttcaagtaatttcgatttatcaaatggcaataatactcaaactggtggtgtaggcactaacaacgtgctatcagtaattgcagagttgttaagtaatagaggcaatgatgacggacaacaggcaactgttgaacaaccacttattctagaactcaatgacgatgtattgggtagaactgctattaaagtgatcaacaaagaaattaagcggactggtaagattccgctcaacatttaggagggattgatattcgtgtcatatttaaaaattggtgggacagcggttaaagcaccgcagtcttttcaggtagcaattcaggatattgatggcaatacaacaagaaatgcaaagggtaatatgaaccgagatagggtcgctgtgaaacggaagttacaagtttcatgggggccttgttctatggctgaatctgctgctattcttcaagctgtgtccccagtattcgtttctgtaacttatcccgatccacaagatggaaaaatagctacacgaaccttttatgttggcgaccgaacggcgccgacttattcatggaacgctcagttttcacggattgaatggaaggggttgtcttttgattttgttgagaagtaaggagggattatatgttgaaagtgagtgacgcgtttaattcagcgtttgcggcgccggatagagagcttcgtgcacgtgtcacgattggaaagaccgtttacgatagtgatgatttaactagtattaattacgattcaggcgcaatgaccggtgagcagttttctattggctcaacctatatgaactcaacaaaaattacttttagtcacttagttgaaggtttgaaacaactagatgaagtattgttagagttcggcattgttaaagctgatgggacaactgaatacgtcaagatgggcacattcattattgatgataagattcagatggaccgcaacaacaactcaacaaccattgaatgtatggatcgaatggtgatgctcggcggagcgtataaatcaaagctgagttatccggctactattaaatcagttgccgtagaaattgctaatatggctggcgttagagttaacgatacaagttttgcaagattgcctaaccaatctatcaatgaaccgattggttattcctaccgtgatgcgattgggattattgcacaatttgcaatgggatttgcattgtttgatcgtgatggctacctcgatattagaacgcttgttgatagcgaatttaaaattgacccaagtcaatacttcctaaaaggccttgttaaaaacgagaccttttttaagttgaatggtattagttgtactgttgtgactacaagtaaggatgaaaacggtaatgagacatccaaaacaacggtgctgcaaagtggttcaagttccggggcacagatcaagttagctaataacgtcatgactcaagatgttttagatcgtatgtatgaagcgctcaagtttactaattactatccgttcagtttaaattggaatggcaatccagctgttgaagctggtgattggttaacagtcgaagatttacaaggtaatgaatttaaagtccctaatatgtcttacacgcttacttacaatggtggtttaacagctacctctaaggcagatacgtcggttagttcgccggcaacttatagttatggtgggacaattagcaatattgttaatgaaattggcggacgtgaaagtgctgaaggtaatcatatttatgaagggactgaggatcaggaaccgacattgtctaaagagggagacctttggtataagcatgctgggcctgatactgaagaacggatttataaggatggaaaatgggagttcctaacatctaccaaaaccgctaatgacgcggcagacgcagcggacaaagcatcaaaagaagccgaagaagcaaagaagcaggctaacaaggcagtagatggtgccaatgatgctgtggccaaagctgggtttgcaaacgacacggcgacacaagctaaatctgatgctgcgacagctggtcaacaggctaaagacgctttaaccgacgccaaaaaagctttaacggactctggtagcgcaatggctgactcaacgcaagcgagaaaagattctgctgcggctgtggctgatgcatcgtctgccattgctaaagcaaactcaacagcttcggaattcggtaaagttagccaaaaagctgacagtgctttaaatagtgcacttgatgctcaaagtgatgctagtatcgcggtgacccaagcatcgtccgccgcagctgactctaaagatgctaagcaaattgctggagcagttagtcagagttataagatgttaacagacggatcgactatgaccattgccgaattagaaagcggcttagctgttaagctgactaaaacagatctgaatggttatgccactgaaacgtgggcgcaaaatcaaatcaatgctactgctgatgggatcagtgctacattgtcaagcgtcaagagtacggtagacggccaaacgactagcattaatgatttgaaagctgattccagttcattcaaaagtcaattcacgactgttaacgacacattgggaaagcaaactactgatattggatctttacaagcatcatctaaagaattaactaccgggtttaatacgctcactactgacaacggcactaataagaatgatattagtcaacttaaacaaaccgccacggaagtcagcagcactttagaaaccgttcaaacgcaggtacaaaatagtgctgtgggaacaaatctgttttcgcaatcaacagctacagctggatatgtaagtggcacaattggttatattagtccaccatctacttctaatgaaatagtgtctgattatatttcggtgagcgcaagttctgcctacacttttcaaatgtggggcactactccgaacggaaactcctactggtatggcattggccaatacgactctgataaaaattttatttcaagaccgtcaggaggtggaagtaatcaaacatcggatacggcagaatatgtatctaaaactttaacaaccacttccaccgcggcatacgtgagagtttcttttagaaaatacgatgattttaaagccaaactagaaaaaggcagtttagctactgattggtgtcttaatccatcagaaactgccacggttactgctgtatcaaagatttcgcaaactgttgatggtatgaaacttgatatctctaagaaaattgagaaacctgatctaaatggctacgccacccagacatggacacagtcgcagattaaaatgactgctgatggaattaacggcaccatgtccagtgtcaaaacgactgttgacggtcagacaactagtattaatgacctcaaggttgactcaagttcttttaagagccagtttacaaccgtcaacaatactctcggtaaacacactacggacattggtacattgcaatctacgtcaaaagaattaaccagtgggttcaatacgctaacagctgataatggaactaataagaatgatattagtcaacttaaacaaaccgccacagaagtaagcagcactttagaaactgttcaaacgcaggtacaaaatagtgctgtgggaacaaatctgttttcacaatcaacagctacagctggatatgtagatagcacaactgggaatatcgattcagcaactgcttttaacgaaaaagcatccgactatatttcggtgagggcgagttctaattacacttttcaaatgtggggcactactccgagtggtaaatattactggtatggaataggtttatacgattctgataaaaaatttattgtaagaattgataacgggggaaagatacaaacatcggatacggcagaatatgtatctaaaactttaacaaccacttccaccgcggcatacgtgagagtttcttttagaaaatacgatgattttaaagccaaactagaaaaaggcagtttagctactgattggtgtcttaatccatcagaaactgcctcggttactgctttatccaaactttcacaaactgttaatgggattcaaacgaccgtttccggcaaggctgaccagtcacaaatcacccaactggctgggcagattactagtgttgttggtgacgtttcagcaaacagctcacagattacgcagatgaaagctgacatcaatctaagggttaaagcgggcgacgtaatcaaccagattaacatcagtccggaaagcatattaattgctggtcaaaaagtccacattactggacaaacgtcaattgataacgcagtaattaaagatgcgatgattgaagacattaaagccgataagattacagccggtacgcttaatgctgctaacgtgaatgtgattaaccttaatgctaataacatcacgacggggactatcaagggcgctaatttaagcttgaatttgaatactggtgaagtcgcatttcaaaagggctccatacgttctacaaatggtaatttaaatattcgcattgacgatggttctatgagtttgacgaatagcctcggtaatggtgcttactttaaagacggaaatatctatatgacggactccgacttctggacacctgggaatcccaagattcaatatgggactcttaaaatggtacctaacttcttatctgatgctggtggcggggtagctttaaaaggtccgaacggtgttgttgttggaaccgacgagtatttagacacaggcattctgggggacctgttgtctagtatctctggtggtggtatcactctaacaaaggagcatattcgaatggcatccgagggtgatataggtattgctggtggcaagatgtataactcaggttttgtaggagaacttcctgctatccaagtggggattgctggttcatatacggcaccaatgccttggttcccatctggcgaaactggggacgcacttttcttatctggaaaagtggttggcgtagtagcaagtaacggtactggaaatcttatgacaaatactataagtgatttatctgcttcatgcgatgctcgaagcggatacgtattatcagctgccacatacaaacggacatatggttcgggcgatactgttacaatcacacctaatggcgtgtttggccgtatttcatctgcttcaaagtacaaactggctattggagagatatcaactctaaatgatgaggctcatcaattcttatcagtcaaaccaaaacaatggtttgataaatcggagactgaggcattagccgatagtatgaccactggcaatactgactatgttgatgatgctaaggcgttaccacacaacggatttattgccgaagacctatacacggcagggctagatagctatgttattcgtggtaacgatggttctattgaatctatccagtatgatcgattgcccgtattacatcatgagttaatcagagagttatttaatcggttagatgctgctgaaatggaaatttataagttaaaacaggaggttcttaacaatgcaaactagtgatattcaagttattaacactgtcacaccaaaaggcgatggtgagaaatttacgattaactttacgactcaaactgatgattttagtatcggttcgggtcgtattttattaaccgcgtctgaaatggcagaggttacggaatttaataaagcagaaacaatcctaaataaattgaaagaggtaattaaataatgacaaaaacaattaatttcaaatatggcgaattggttccagtagcgaattttatggctggcttagatttagttaacaaggcaagccgtgctagaacaaaacttatcaagctgattgctgaaaaaaatgaagagtacaacgaagatgaaaatgaagctgttaaagatttatatgaagatggcactcttatcaaaggtaaggaaaatgaagtgcttgcaattaaaaatgaaatgcgggtagaagtttgtgtgttgggtttgacggaatatattcctaaaatggtagatttacgtaatgccttagacaactattctgaaacttttgcagattccgacgctattctttacgatttggttatggaccagttagagacgatttcagaagataaaatggaggaaacaaaataatgaatattaaaaagacagcattaacttataatttcgacggggatggaaatacctcatcaatcaccgtaagcttatctggtaacgaaggcacagactacttaaacgccaacatgtcggtaaccgtatccgatttaacagacgggcaagcgttcgacaatttaactatgaaggacattacaacgattgcacgggctaagttagctaaggcaacggcggttaaagaatagaaggaggaatagcatggtttgaacaatgataaagatgatttaaacgtgacagagatgttaatcgacattcgggagcggttagcccgcgtcgaagaaaacactagcaatcttgattcaacggctattaaagctagcaaggcttattcgatggctgaagaaaatcaaaaggatattaccgatttaaacgagagatctaaatggactcaacggacagctattacagccatcttgattccaataggtctttttttatttgaaaaattaataggagggtaattaatgattaaaaaagtagattggcattcaaaggtgctgtggacttcgctgacagcgctgttcattgtgctagttcagcaaatagccaaagttttcggggttgaattcagcaacgacttagccaaccaggtacaaggcatcgttaatacggtgcttacaatcttaggtttagtcggtgtcgtctatgacaccacgaagggagattcaaaatgaaaaaattaaataaactagtagtcgcctttggggcggctattttatttgcatcaactactatgattggtggggcacaagcgtactcggtcaataacacttatcaattaggcgttaacgaaggctctaatcaacgtactaataatcggttagtgattgcgcatgaaactgggacttatgcgccagcagttaataacgccgcgtatatgaaacgcacttggaacactaactatgcttatacgcaatacgttgttggtgacggtggtcaagtctatcgtgttggtgctgatggttatgtaagttggggtgctgggacatggggcaatgccaatgcaccagtccaagttgaattagcacgcacaactaacgatgctcagtttaaagtagattatgcagtttatgttaacttgctacgcgactcggctaagaaatttggtattagcactaatttagataccggttacgggattgtaacgcacaaatggattactgataatgtctggggtgatcatcaagacccatatggttatttggcaagccatggcatttctaagtcacaatttgcgcaagatttgaagacagggttacctgaaaatggtagcgggacaaacacaacgccaatcaatccagttaagccaacgcctaatgctaatgaatgggcggaaaactggcacttcaagaacggcaatcaaccaatccaagcgcgtctcggtacaccatcactaagcgcaccatatgccggtaagctaccagcatggacaacaatctactatgatcgcgttgcagtccgtgacggttatgtttggtgtcactggacaactaacaacggtaattcggtatggatgccggtacatccagttggcacagccaataatgtttgggtatcatttgactaacataggacattaaataagcctaactcactaaattgtgggttaggcttgtttttttgctctaaattatcatcaacaaactgttttgtatttctttacttgacttatacgaatgtacgttcgtataataaagctcataaaggagtggtcaagatggaatatgtcagcctaaaagggactatcaatggcgctgttaaagtaattagcttcacaccatatcttgttcggtttgaacttaaaacagccgaacagaattataattgcctggtcgcaaaagacgcattgaacttcatgtatttagctaaagaagctgcaccaatctcaatctttggacacttcaacaagcgtaaacaattagttgtcgataagtaccacgttcagagcggagtattagtgcgatgactaatagcgattatgatcctaatttggttaatcagtttttgaagcatgattaccatgaccgcggaatgatgaaatggcaaggttttttcctgagcgaccacactgctaatataaataagacctcacgggaacaagaagaggtgaatcgccggcatcacggacccgcaatggaacaagatgatattgcagagattattaatcaggcaattgttaaaagcaagcatgtgcagattgagttgggcgaacaaacaattgatgggattgttcagaaaccaataagcggactaattcaaggatggattgaccaacagatttttataggtgatcagtctgttatgattgaagatatttgggcaattgaagtgatctagatagtagaaagagacaagaaaagccaccatatcaggtggcttttttatattacgattattccattaaagtgcaaattcatctaatgactcaacttgggtaagaaggctttcaaaccagaaactagccagtgtatcatttttgaaatcaatggttaaattactttttccttctattacaatggatgaatcatgcaattcgataaataatcccaatgctttaatttgtaaaactgtcataattacacctccaattataagtacgaaaacgagcctgccaactttttgccaactgcggataaatcttgatagaatggactgaaatatagtgagaacgaatggaagtaaaaactaccgataaatgcaatagtgacaaatgttcgtgagaataagtgagaggcactgaagaacgctggaatttctcgtgtctattagaggcgttcatgtccattttgaagatgaatgatgaagataccaaaggtaaataaaaaaataaaagcgtgctagtcgaggctgactagcacgcttttttgcgttattgaaaagaaataacagttttaccaacacgttaatggatagcgattgagacgagcaggatgtttggtccctataaaaagccgctccagaaagctattcatgctgcgcgctgttgatgggtgcaaataacttaatgcaatataatgcgctaagtccaacaaggacatatacgatgcgcgaaataatagctgcttgaccgccaaataacatagcgactaggtcgaatttgaatagaccgacaagtagccagttcaaaccaccaacgattaataaagtaagcgcgatattgtctaaggttttcatagtgacacctcctttagtagctttaagataacatcctcaaaggtggggaacaataaaattgcttagaccaagttttgtaacttagcaaagaattaagggtgggtttttagaagatagattgcaaaaaaagcatgctagtcaaatttgactggcatgctttttggtgtttattgaagcatatcgattagtttcagaaagatcatcatcacgaggatgctgacccaaaagagcacattcgatttcttcttaagttggtcatttttcttttgttgggcgatgaataagatgactgatgaacttaagacgccgattgcagcaatgatcacgatcaataataaaatgagatgttgagcaggtgacatgatgaggctcctttaactgattgattctaaggagcagtataccaaaaaaatggagagacgagaatagtgaatctacctgatgaagcattaactcttggtaagatacatcgtttttaattggttgagatccgccttagtcaaacccagcccgtgtttcaaataaccattaacgccaccatattctttgttcattgtgtcatatgcggcctgtagatagggtttacggacggccatcattgcagtgatcgttttaacggctttggggttattgtgagttgccaccttaatttgttcaattgtcttttcattttcggcgcggcgatatttattagaggcgaggtagtcgtccatgatgctcttttgatcaaccccgagggcactgaggactaacatagtaccgaatccggcacgatctttaccggctgtacaatgccaaagtgtcgtaccacttttattattcaataagacattaaagaactgtttatagttcgtgcgtgctgcgggatcagtaaccaatttttggttaatatcaatcatgaaagcttcaccatcaaccttatcgagattcttgaaaaagtcagcttgacttgccgaagtccctaaagacttggtgacatcatagtgattgtagtggacgttgcttaaagcgggatcgggtttagccgcaacttcgctactagtccgtaaatcaacgatgttatttaattgttttccaacggttaacttctgtttatccttcgttgttaaaccagctaattcaccagaacgaattaaccgattggctttaattttggcacctgttttcgtgacaattccacctagatcacgagtattaatcgcaccggctaattgaatgtggcgactcatgttttgtttagggacaagggtggattgatgagctgtcgattgtttagtatttttttgtggggtacagccggctgccaaaagtaataaagttgttgttgccacgtaagggatgattgtttggctcatgcgcatattgattgcttcttgtaaaacgattttttattctttacaaggttaagcataaacaaataatgtaaagtgtttgttgttctagtgaaaataaagtgtaaagcttcgtaatggtttggtaaattcataaaaaaagcctagtagtggtttaatgatacaatggggggtaacttttagatatggaggatgataagatgcatgcaacgcaactattaagtgcaacggtcgaacgcgctcaagaacgattactcgatacattggaacaaatgacagtggctgaggccaatacaatgccgcagccactaattaaatcggtgacctggttagtatggcatactgcccgtgaaatggattatcagattgcggatttgaaagggatacaaccattgtggatacgtgcaggttggtcacaaaaatttgcattagatctacccgatgaaacgcaagattggtcgcattcaccagaagaagcagccaaagtgattatcatcgataaagcattattaattggttacttagcagacgcattgcaattgacgcttgattacctggctgaagttactgacgagtctttattagagataattgatgaaaattggacaccggcagttacccgtgaagcacgcttagtctcaatcgtggatgatgcggtcatgcattccgggcaagctgtttacactagaagaatggtaatggggaaataactgataggacaggattggaatcggtttaacgaataattagtgaagggtaaaaatagataccgtatggtatctattttttgttatccggcaattgaattgcgtgctactatattaaatgtaattaataataatttggaggaattatcaatgaagacaaaattattttcagcattagcaacaatggtagcaccaacagcaatgacagtggggtcagtatcagctgacgcagttgctccgcaaacatcaaaagccgactttagtgttgttgctaaggatccaacaaacccaacagatcctgaaaatgggacattagtattaaaatcagtaccaagtttcagctttgggacaattgaagctagtgagatttatgctggttttactggtaaagttgctaaaacagctggcgctttagaaattgctgatatacgtttaggcaaatctgactggtcgttgacagctgacatggctcaattcacagatgatgctaataaactaacaggcgcaatattgaatttagattctactggttcacttggtgaaactttaacaggtgctgttaaggacgattctcctgccgttgaagtggttaaaggtaacgggaaacatggtgtcgataatttcaagatggaagcagctacgttaacattagcagcaaatccagcagccgatttagctaaagatgagagtttcacaacaacaattaattggaatctttcatcaacaacaccaactgcaccaactgcttaatcattttactattaaacgcacgaaataagtgaataaagttaacgaagcgattgatgtggagggtgaaaagtataagccagatttgtattatactggaaaattgaataaagatccgaatacaccagggattccagctaaatataaaattgctgcagggaatgtctctaaagagaaaacggtttatgttggtgggttagcagcctacaagaaagcggcggatctcggtgggacttggtcagttgatggtttgtcagacctagctaaggcatctggttcaacgagtaattggcattatgaatggcaatttacagatggtgaggataagacaataacccccgctactaatagtggtgtttctaatcttaagggtgacattacaaatttagcgaacttaaatacggaacaaccactaacctttagtaaagatagtactttcatgaaagatgctgcagctgcaactacggctggaaagagttatcgagcacagctaacattaacgactaacgtaacggaagaatcaagtggaagttcaaaaaaagttacgattgtttctaacgaagctgaattacaagcgcaaccagcagttggtaagttgtcattggatcaagtgcctagctttagatttgggaacgtcttatcaaaagatatttatgttggtacaactgctcaggacaagcaatatcaggtcagtgatgggttgaaaatcacggataccagagcaacgccaggttggtaattgacagtgaagatgagtaaaatggcatcaaccacaggcaaacaattaagcagcacatccattaatatgactggcttgccaacgaacgtaggattatctgataatggtactgaaataccgattatgacggataagatgtcgaaaacatggcaagttgctgggaaattagcattaagtgccaatccaaatattcaacttgcggctggtgatacattctcgagcaacattatgtggactttaaatagcgcacaacccgcagcacctgctgcttaagttgttgattagaattaataagtaaattaaaaaagatgaatgatttcctgaatatcaggaaaccgttcatcttttttcgttagtcgatatatttaacagccgtgccataagcggcaactgattgcatatctgttccgattgaaccagagtcaaagcgcatcatgacaaccgcatctgcgcccatttcaagtgcgttttggcgaagccggtcgatggctacgtcgcgtgattcagtcatcatttcagtataggccttgatttcgccaccgacgacatttttcaatgaagcgccgatgtttttgaaaacgttcttggattgagtggttaaaccgaaaacttcaccgagcacttcatattttttaccaggaatggtttcggtggtggtgatgagaattggatttgtcatgattaaagctcctttttagaagaataagattaacaataatgtgattaaagcgggtaagccttgtaagaagaaaattttcttggtggcggtaaatgtcccgtaaagcgcaacgatgaagatgtagagcattaatagggcgaggacaatcttgagcgtttggccggctaataataggttgaccatgataattacggcgcccaacattccgttataaatgccttggttggcaagtgccacgcgggcatttggtagtttgacaaagtccagcggcatgtcaaaagctttcgcctttgtttcagcactggcaaacatttccagccccatgataccgatgtgttcaacggcgattaggtaagttaaaataagaatcaatacttgcataagttagtgcctcctcaatagtggtttcattgtaacaaaaacaatggcgcacgtccaaattaggttataaaaaaacacgccagagaatttctggcgtgttccttcatcattaaccgcggtctgtataaccgtttggatgatttaaatgccaattccaggccgtttcaataatggcttccatattgtcatactgtggtgtccaacccaagacttcgcgtgctttgtcactagctgcaatgagtgtacttggatcaccagcacgacgcggtgccattgtcacaggaattgctttacctgtcactttacgagcggcttcgacaatttccatatttgaaaaaccagttgatgagcctaagttaaaggcgttactatcgtgaccagcttcgaggtaaccgagggccaaaatatgggcgtcggctaagtctaacacgtggacatagtcgcggacgttagtgccatctggtgtatcatagtcatcaccaaagatggaaagttgttcgcgtttgccagcagccacttgtaacacgattggtaacaagtgggtttctgggtggtgatcttcgccgatcgaaccgtctggtttggcaccagcaacgttgaagtaccgtaatgcgacaaacttgatgccgtaagctttgtcagcccatttcatcatcgtttccatcattaatttactttcaccatacgggttggttgggacttgtggatcagtttccttgatgggaattgattttggttcgccgtaagtggccgctgttgatgagaagacgatgtgtttgacgtcgaattcattcatcacttcgagtaaggcagtcatgccgtatgtgttattgtcgaaatatttaagtggtgcttgcatcgattcgggcacgattgagaaagcggcgaaatgaatcacaccgctgactttttcttgttggaagacgctgcgcatgaaatctttgtcgcgaatatcgccttggtaaaagcgcgcttgtgaattaatggcggcttgatggccggtgacgagactgtcgacaacggccacatctgtgccgcgttgaattaattgatcaacggtgtgcgagccgatgtagccggcgccacctaatactaaaactgtcatggttgtttccccctatgtaataaccttgtgtatcaattaacagtatatcatttggactgataaacaaaagcattgattggattattaaacgaaatataataatctttgctataatgggtaagttaatgatttggaagtagcgagggattaatgtggaagcacaatatgaatggcaattaaaagcaacaccaactgaccaagacttacaagcaataatggcagttgaagcactcccgaaagccgcagcccaattgttgtggcaacgaggaatcaaaacacctgaggcaatcagtgcgtttatgcatccgaatgtcggtcaattacatgatccatacgctttgtatgatatgcaaacggcagtcgatcgaatccaagcggctgtgatgggcggcgaaaaaattacagtctacggcgattacgatgccgatgggattacaagtaccgctttgatgcaagagacgctcgaaagtttaggcgccgatgtggaagtatatgtgcccaaccggtttaaagatggctacgggcccaatttagatgtctataagcaactcgttgaaaatgggacccagttgattgtgaccgttgataacggggtgagtggcttagagccaatcgcctacgcgcaagaacacggtgtcgatgtagtggtcacagatcaccatgaactaccaagtacattgccaaatgcgacagcaatcattcacccccgtcatccagagggacagtatccctttagtgatttatgtggggttggggtggcatttaaagtcgctacggcattattggaagaaatcccttacgagagtttggacctagtggcgattgggacggtctgtgatttagtgtcactgactgatgaaaatcgcgttttagttagcttaggcttacaacaattacaaaataccagtcgtcccggtttagtggctctttgccagtcagcgggtattgaacaagaagcgcttgacgccacatcgattggatttgggattgggccacgtttgaatgcgattggtcgcttaggtgatgccaacttaggtgttaatctattaacgactttcgatgaagaacaagcggtggaacaggcccaatttgtggaacaacaaaataaaaagcgccagggtcttgtgcaagaaattactgcgctagctagcgaaatggcacaaacacctgagaaccaagctagtgcgaccttagtgttggcacatgaaggctggcatgaaggtgtgctggggattgtggcgagtcatatcgttgaacaaaccggtaagccaaccttagtgctagcaattgatctagcaactggccaagccaagggatcgggacgaagtgttgaagcatatcatctctttaaagcgcttgatgcccaacgcacattgttgacgcactttggtgggcatcatatggctgttggcttaacgatgccagtcgatcaattggctgctttacaaacggcgatgaatacttatgccgctgataatcagattgatttaacaacgaaacccacattggcggttgatttacaactcgcattagctgatgtgacgcccgatgtttatcaagccatcagtcaattagctccttatggcacggataacccagaacctttgattgaaatgacggtgccatccgtcaccaatgtgaagcagatcggcgcggatcaaaaacatttgaaatttacggcggttgatcaagaagcgcagttagcagtcttagcatttaaccgtggtgcgttgtacgacgatttacaagcggtggaacagttgaaattagttggtcaactaagtgagaatacttggcgcggcaatacgacgttgcaattgatgctgaaagatttacaaacgagtgggcaagtgttaatcgatcaacggagtaatcggttgacgcaacagttgtttaaagctagtggcacctatgtctttttcaatgagaagcatctggcacagctacaaagttatatcccagccggcagccaagccatcttagcagccgatgtcgcacagcaagcagaattgattgtggttgatgaaccaactgatttagatgaatttgaagccttttatcgccaacaacaggccactaaaatcagctttatcttctatagtaagtattcggcatatcttgatggtattcctgataagaaacagtttgcgactttcttggtttacctacgtcaacatccaggaattgaaaaagcacggttaggggaattagcgacttatctaaaaattaaattgccgctattaatttttatgttgcaggtgttttttgacttaggatttgttaaaatagaacgtggtctcatttcggccgcggaacaaccggaaaagcacgcattagaaagtgcaccgagttatcaacaacgattagctaaaattgacatggaaaagcagcttgtttactcaaccttcgcggagatgaaagactggctggcaggattcaatcagtagcaaactgttgaaagagttaaggagcgaattaaaaatggcaatcaactttaaagattacgttgcaagtgtgcccaacttccctgaagaaggtgtcacattccgtgacatctcacctttgatgtctgatggtgaagcatacgcagcagcaaccgacaagatcgtcgaatacgcaaagagtaaaggggtcgaaatgatcgttggtcctgaagcccgcggattcatcgtcggctgcccagtagcttacaaattaggcgttggttttgcaccagcccgtaaaaaagggaagttaccacgcgaaaccgtctcagcaagttacggcttggaatacggcgaatcaacattatacatgcacaaagacgcggtcaaacccggtcaaaaagtgttggtcacagatgatttactcgcaacaggcggcacaatcgccgcaaccatcaaaatggttgaagaattaggtgggattgttgtcggaacagcctttttaatcgaactaaacgatttaaacggtcgcgaaaaaattaaagactacgatatcttcaaattaatggattactaatgagtgtctttctaagctgggagagtctgagcattaacttaggttggcaaataaccgatgaaatcggttgtttgccaaccgacgttaagcgcaggaatctagcttagaaagcgcgttaataaatgagtgtctttctggtgcggttaacttctgagtatagcttagtccagtgaataactgatgcaatcggttgtttgcgggacgtggctagacggaagaaattgcatcagaaagcacgttaagaaaaaatgtaacgtcagtcagtcgttaaacatagggacatggctgaaggaacacgctaaaaaaggattcgccgttatggcgaatccttttttgatagctacattctgtcgcggtataggccaacgaccttacctaagatgctaacttcattcaaaataatgggttcaaatgtatcgttttctggttgtagccgataatgaccaggttccttgaagaatcgtttgcaagttgcttcatcttcagcagtcattgcaatcacgatgtcaccgttatcagcagtcgcttgtttacgaacaattacttcatcgccgtctaaaattccggcattaatcatactttcaccgcgaatcgtcaacatgaacaaatcttgttcagtttgtagacttggtggaatcgggaaataatcggtcgcttcttcaaccgctaaaatgggcaccccagctgtaacaacaccgagaaccggaatcttcttctgtgatgcaccaattgctgtcaaaccagctgctgttaattcaatggcacgtggtttagtcggatctttttgtaaaaagccttttttctcaaggcgtgctaaatggccatgaacggtagaagtagaggataaattaacggcttcgcaaatttcacgaaccgttggcggataacctttatcttgaacgcggtcatggataaaacgcaagacctctaattgtttggattctgttctcgtcataagagcacctcatttgttctaatagctatatgttagcatacctatagcgggatttcaaacaagtgttcgtattttttgacattttacggattttagtccaaaatagacaaataggttgaattggaggactacaagatggcaatggatcaaaaacgattagacagaattaatgaattagcacacaaagcaaaagctgaaggactaactgaagctgaaacagcagaacgtcaaacactgcgcgatgcctatttaaaggatttccgcgaaagtttccgctcacaagttgagatgctacaagtgtatgacaaagaaggcaaggaagtcacacctgaaaaagtgaaggatatccaacgggaaaaaggcttgcgtgacgattaatcttagaattccgctttctttttaggttaataatgtgtaaactatttaagtgaactgaattaggaaggggtgcataagatatgggattaggcattttattatttgtcattggggctttattaggcgcagtcgctggtttctttggcgcacgtgcttacatgaagaagtatttccaagacaatccaccaattaacgaagaaatgttaaaggctatgatgatgcaaatgggtcaaaaaccatctgaaaagaaattaaatcagatgatgagctcaatgaaagcacaacaaaaacgtagcaacaaaaaataaaacagttaagtcggttttaaaagggtttctaacgaacaagtcgtttgttagaagctctttttttatcataataagaacggaaatacaaatgattgtccggcttaattaagattgttataataggacttatcgaattttagaggataggagcacaacatgggaatttttaaaaaactagggtggtattttaaacaagaataccgccgctatttatggggcgtcatctttttagtcctcgtggcgattgtccaaattgtgccaccaaaagtgattgggaccctggttgatttaatggacgccaaacaattaacggcccaaaaattaatcatgtggctcggcgtcttgttaagcgcagcgattttacaatatgtttttcgctatggttggcggacccggatttggggtggcgcggctaaactggaacggacattgcggagtcgattgttctggcatttcatgaagatggacacgaccttcttccaaaaacatcggacaggtgacttgatggcccatgcgacgaatgacttaaccgcgattcaacaagtggctggtgccggtattttaacctttgccgattcaatcatcactggtgggacaacgattattgcgatggtgattttcgttgactggcgcttaacattgatggccttgattccaatgcccttgttggccgttgtgtcacgacggttaggcgcacatttacacacagcgtttgggcaatcacaggcggctttttcacgattgaatgataaaacccaagagagtgtctctgggattaaagtcttaaaaacgtttggccaagaagaagctgatattaaagatttcaacgagattgtcacgaagacaattgtgattaataaacgtgtgaatatgattgatggcttgtttgatcccgccatcagtttgattatcgggttaacgtacattgtaacaatcatttatggcgggacgttggttatgaatcacagcatttcgattggtcaattgatttcgttcattagttatatcgcggcgcttgtttggccaatgtttgcgattgggcgcttgttcaacgtcttggaacggggcaatgcgagttatgatcgggttgatcaacttttgaaagaaatcagcaccattgtcgaagcaccggatgcgattcaaacaccagcaactggcgatattcattatgctgttcaaaaatttacgtaccctggcgacaaacaaccaacgctcaaacaggtggcgttcactctgccacaaggtaaaacgttgggcattgtcggaaaagttggttcgggtaaaaccacactgattaaattattattgcgtgaatatgatcagtatcaaggcgagattcaaatcgatggtcacgatatccgagattattcgctggatgcgttacttgatagtatcggctatgtgccacaagataatttcttattttcaacggatgtccgcgacaatattcggtttgctgattttgaccgaaatcaagcggcggttgaagatgccgcgatttcgagtgcggtgcatgatgatattttaacgtttgtccaaggttatgaaacggtcgttggtgaacgcggtgtgtcgttatctggtgggcaaaaacaacgaattgcgattgcgcgagcgattatgactgatccagaaattctgatcttagatgattcgctatcagccgttgatgcaaagactgaagaagcgattttaatgaatttgaaaacgatgcgggctgatcaaaccaccattatcactgctaatcgcttgagtagtgtgatgcacgccgatgaaatcattgtcatggatgacggtcaaatcactgaacgtgggacacacgaagcactccttgccgcagatggctggtacgcagagatgtggttgaagcaacaattaagtcaagccttaggaggtgcataagatggccaagcaatatcaatcagaatggtccaagaaagttccattgaaagagcaattgcacatcatgaaacgcctctttggttatacgaaacgctataaacgccaatttatcggcgcaattgtggccgccgcaggtttagcgaccatcaatattttattaccacgattactacaagtctttatggatcgttacttaaccaatcagagtgcgaccacccaagttttaatgggggttgcggcgttgtacggtttaggcgtgattctcaaagccattacacaatttttccaatctttcctttttggaatgggttcggaacgcgcgatggaagatgtccggcgcgatttatttcagaagctccatcaactcgggatgcgttatttcgatcagacgccagcaggctcgattgtatcgcgggtcacgaatgatacgatgactttgattgattattggaatgttttcttatccttgttagtcggttcattttcaatcatttcagcgttcattgcgatgtggttaatttcaccaaaaattgcccttgcaacggcagcgtttctaccaatattgttaattgttatctggtattacagtagttacagtgcgcgggtttaccggcatatgcgtgaaaaattgagtcagttgaatacgaaactcaacgaatcaatcgaagggattacgattatccaacaattccgccaggaaaaacggttgaccgacgaattcgaacaagttaacgcggactatttaaaaacgcgcgaagcgatgattcgaacgaactcgttgttgctcgcaccaattgtgaatttactctatacactggcattggtcgttgtcttgagcttgtttggtgtctcagccctgcatagctttgtcacggcgggtttggtttatgcgttcacaacctatgttgggaacttctttaatccgatgaccaatatgatggattctttatcatcattacaagatggaatggtcgctggtcgccgaattttcagaattctcgatcaagaagaatatgcgccagctcaaaatgccgatgctgcaaatgaaattactgagggtcgcgtcgaattcaagcatgtttcgttttcatacgatgggaaaaatgaaattttgcatgacatctcatttgttgttgaacctggacaaactgtcgccttagttgggcataccggttctgggaaaagttcaatcattaatgtcatgatgcggttctatgaattttatgaaggtcagattctaatcgacggacatgatattcggagttttcagacagcagaactgcgccgcaagatggggcttgttctacaagatgcattcatgttttatggtgatgtcgcatcaaatattcgattatttaatcaagagattacagatgcccaaattcgcgcagcggctgaattcgtgcaagctgatgactttatcgaacaattacctggtcaatatcatgctcgtgtaattgaaggtggcgcccaattttcaagtggacaacgccaattaatttcgtttgcgcgaacattggttacaaatcctaaaatcttggtcttggacgaagcgacggctaatatcgatacggaaacggaatcgatgattcaaactggtctcgctcggttacgtcaaggacgtacaagtattgccatcgcgcaccgtctatcgacgattcgcgatgctgaattaatcttggttttagatcaagggcagattgtcgaacggggtaatcatgatagcttagtggctcaaaaaggacgttattatgaaatgtatcaactccaaaatggtggcagtgaagaataagcagtttcaaaaaaacacgactattattattgcggagtaaatcgggaggaatttagcacatgaagaaaagacgctggctgaaatggtcgttaattagcgttgttgtcttagtggtggtagcactatttggtgccactatgtatatgtatcaatacgcatttgtaccggggcaaaaatcatttttaaatggtggtaagccaacgaaagtctatcaagacaatcaacgttggttaaaaaatgttaaacaatcaaagtggcatcaacaatctgccacagatgatttaaaattggcggcaatttatgtgccagcaacaaaacctacgaacaaaacaattttagttgcgcacggctatatgggtaaaaaagaggatatggcacgctatattcacatgtatcacgatcttggctacaacgttctcgcgccggatgaccgtgcagcaggtgaatcggaaggcgatgccattggctatggttggacggatcgcttggattacgtcaagtgggcccaacaaattgtcgctaccaacggacaggatagtcaaattgcccttttcggggtcagcatgggtggcgcgaccgtcatgtttaccgcgggtgaagaattacctaagcaggtgaaagcggtgattgaagattgtgggtataatagcatcgctgacgaactcgcataccaactaaacgatctctttggattgccgaaattcccgttattttacacaacgaattggatggcacgggttcgcgccggctataactttaatgatggcgatactgctaagagtttagctaactcgaaattgccaatcttcatgatccatggcgatcaagataaatttgtaccaaccaaaatggtgtatacaaattacaaagcggcgcatgcacctaaacaactctgggtggttccgggggcagctcatggtgaagccttggctacagatccaacaacctatcgtaataaagttgcgcaatttttaaatgaatatcttcaataagtctgtttaattgtattttgaagtcgatttggtgtgatagatatataaatatattgatatcgctaatccgttaggtgaggctcctatatgaacaaacgctgctactcagaaacatcgagagatgccaattgagtcaacaaaaactgccctgaaggctttttctaatgtagctgaacaaagttctacgtcatatagtgctaaagctcaacgattggaatggcttgtttttcttgtgaggcatcctttctttgaggatgccttttttatgcggatcagctgcgaatgagagggattacgatggctaagacaattaaaatgacactcaatcagattaatcaattaacgccaaaagcgagtttagaacatttcgaaactgacaagaaggggttatcacggcagcaacgaacagcacggttacaaacctatggggaaaatacgattcaaaagcggcaacagcgttcgttattgcgagctagttggcagagcgtgcaagatccgtttatcggcgtattagccgtcttaatgatcatctcctggctcagtcgagatattgatggcgcgatagttatgttaatcatgattgttgtgtctagtagcattcgattcgtgcaagagcgcaagtccgagcaagcgagcattgctttacaagcgatgttggcaaagaccagccgggttgtaattgagggtcaaccaactgaagttgccgcacaaagtctggtacctggggatattgtgcagctgcagacgggggatttggtgaatgctgatttaaaaattctggcgagccatgatttacaaattaatcaatcttctttgacgggtgaatcaaaacccgtgagcaaacgcataacagcgtaagcaactgacgtaacgaatgcggcggatatggcgagtttattgctgatgggcagcaccgttgtcaatgggcaagctaccgcgttagtgattgccacgggtcaagcgacttgctttagcgcaattgtgactactgaacctaagtcgcgaccgaatcaatttgatgcagggttaaaacacatcagttggttattaattcgcatgatgctcgttttggtgccctttgtatttgtgattaatggtgtgactaagggagattggcaacagtcgtttttctttgcgattgcagtggcagttggtttgacaccggagatgttaccgatgatcgtcaatagtaatctggcgaaaggcagtgtcgttttaagtcaacaacaggtcatcgtaaagcagttaaaggccattcagaatctcggggcgatgtcggttttatgtacggataaaacggggacgttgacggaagatcatattaaattgatgtactatgcagatattttaggaaagcgggatgtgcaagttttgcgattagcatatttgaacgccaagggtcaatccggctggcagaaccttctggatgaagcgattattcattactatgaacaagaccaaaccaatgatgactttccatattaaaaattgggcgagattccatttaatttcgagcggcggcggctaacggtctggatcaaaaaccatgcaggtaatcaattagtgccaaaaggggcctttgaagaagtgctagcaacgtgttcccaagtcaggttagcggatcagattgagccgttgactgaagtgcaaaagcagaacctagtggcagtgcatgatcgtttggcacaacaagggatacggatgctggcggttgcttatcaagatgagttagcagagacggcatcaattgaccgcgttggtaatcaaggtttgattttcgccggctttttgggctttttggacccaccaaaacaatcagctatctcggcaattcaacaactacaagctcatcaagtggcggtcaaaattttaacgggtgacagtgctttaacgacgcagcaagttgcccaaaaagtgggcattcagaatctagctgtgaccactggtgagatgttagagacgttaacggatgcacaagtcagtgagctattaaccgagcaagcattatttgccaaattggctccacttcaaaaagcgcgtttaatccgtttattacaagcacaaggggaagtcgtcggtttcataggcggtggcattaatgatacgacagctttgaaacaagcagatgtcgggatttcagttgataatgccgcagacctcacaaaggatgctagcgatgtaatcctactggaaaaagatttgaacgttttagaacacggggtgcttgaaggacggagagtctttatcaatatgtataagtacattcggattacgttagcttctaatctaggaaatgttttgagcgtgctggttgccagcatctgtttaccatttttaccaatgttgtcactgcaaattcttgtccagaatttactgtatgatgtcgcacaactctggttaccttgggattgggttgctgaagatcaattgcgccaaccaacacagtgggcaactaaaggcttactgaagagtgcgtttattctaggaccgttgagctcaatggttgatattttaacgtttgcgattctctggtttggatttggcctgcaaacatcagctcaacagggggctttctaagtgagttggttcgtcgttggtttattgacgcagatgctagtagtttatgtattacggacacaagcatcaccgttcaaggatcgcgcaaattggcgtgtttacttggggagtttaatcagtttgttaattggaggtattctggtattgacaccgctcagacaagccgttgatttccaagcgattccaacacaatttggctggattgcagtggcattagttacggcctatctattggtgacgaatgcggttaagaatttaacgcgctaaaaaaactgctagatgatatcatctagcagttttttgttattattttttatcaggtagttcatatttaaaatcagggttaatttcgtggtcaatttgatcaaatgcggcttgcatttgatgattgacaacttctaagttctcttcgttgagttttaatttcggatcgattgggattggttcaccaaaacgaatcgtaatctttttccgttttaaaacatcagagaattttaatggcccttggtagactgctggtacgagtgggacccgcgccatcttggcaattacgaccgcgccgcctttaagttcgcttgaatagcggctaccagtggggaacatgattaacgaaagttcttttgagcgaagggcttttactggcgttttaatcgccgatggaccaggatttgttcggttcacaggaaatgcgtttgcgtgggttaagatgaagcgtaaaattgggtttttaaagagttcttctttagccatgaacgtgaactttcggggactagcagcaagtgcgaagaagattggatcccaccaagtccggtgcgggccaactaaaacataagtcccttcgggcagggcttctttattttcgaccttcaaattgccattcaataaccaggctaaaatgcggacgataaaacgtgcaaatgagaaaaacatagtttagattcctttcaaacgtgactagtatctgctcattataccaaataatgatactctttgttataatatgcctaaatacaaatgaggttgaaggtagaacgatgttaaaagcagatgagcgaattgaccaattatttcgcttagatattcagattattcaaagcccatccgtcttttcctattcgatggatgcggtgttgttagccgactttgcccagttaccaaaacgcgggacgattgtcgatttgtgcgcaggcaatggggcggttggattattcatgagtcccaaaacaaatggtcaaattatcggtgttgaacttcaagaacggttggccgacatggcacaacggtcaattgaattaaatgacttaaccgaccaggtgacaatgctcaatatggatttgaaagacgttaacactaagattcataaggacagcgtcgatattgtgacctgtaatccaccatattttaaggttgaacccaatagtcaaaaaaatcccaatcaacatctggcactggcgcggcatgagattgcaacggacttgcgcactgtggttcaaaccatgagtggcttgttaaagatgaatggtaaagggtatttagtccaccgtcccgaacggttcttagaaatctgtgacgaactacgcgccgcacgcatggaacccaaacgcgtccggtttgtttatcccaaagcaggcaaagaagcgaatatggtgttaattgaagcggtcaaagatggtaaaaaagggggcttacgaatgcttccggaactgacgatttatgaccaagacagccactatacaccagagatgcgcacgaagttattcatggctgacaatgactgagaaggcttattatttttacgtattagtctgcgccgatcatagtttttatgggggtttcacgaccgacgttaccaaacgcgttgccacgcacaatgctggcaaaggtgcgaagtacacaaaattgcgccgaccagtgcggttattatattttgaaacgtttagtgataaatcggcggcgcttaaagcagagtatgcgttcaaacatcaaccccgccgcaaaaaagaacaatatttaatggaacatggcatttcaagaactcaattttagaatggagagaccaatatgcaacctaagttagttgtcgatcaacacattcatttacaacctgtgacggaagcggatgcgccggcgttatttcagttagtggaccaaaatcgcgtcaatctcgatacttggttaccatgggtgggcgatatcgaatcagtggccgatgagcttggctttttaaaatatgcgcaacaacaaatggcaaaccaggaactttggatggcaacgatttgggatgaccaccagttagttggtacgattgatgtccacaatattgatgacttgaatcgtgcgggtgaagttggctattggttagatgaagctttccgcggacgaggtgtcatgcatcgcgcactagccgccattgaacaatacgcggccagtgaattggaacttgaccagttgagtatcattgctgcacacgaaaacgtggcgagtcagcaagtcgcgctaaaagcgggctatcgagcggttgaaacagtgagtggcgttacctcagtgaaccaccaaccacaagatgcaacccgttatcagaaacagttgggcggtatgtaagttcttgttgacgcgccttgttatttttagtatacttttaaacggtatttcaataccaaaaaataattcacactggttgatttctagagaggtgcttggcgacaagttctctaaaaaagtgaaaccagtggtcgaaaaaaaccatatggaggtctgttgacatggctgtattgtcaatgaaacaattattagaagcgggtgttcacttcggtcaccaaacacgtcgttggaacccaaaaatgaagaaatttatctttactgaaagaaatggtatctacatcatcgacttgcaaaagacagttcgcatggttgacgatgcttatgacttcgttaaagaagaagctgctaacgaaggtgtattcttattcgttggtactaagaaacaagcacaagatgcaattgctgaagaatcagtacgtgcaggccaatactttgtaaaccaccgttggttaggtgggactttgactaactgggacacaatccaaaaacggatcaaacgtcttaaagaaatcaaagcaatggacgaagatggtacattcgatcgtttacctaagaaagaagttgccttgttgaagaaacaacaagaaaaacttgaaaaattcttaggcggtatcgaagatatgcctcgcatcccagacgtaatgttcgttgttgatcctcgtaaagaacgcattgctatcaaggaagcacaaaaattaaatatcccagtcgttgctatggttgatactaactcagatcctgatgatattgatgttattatcccatcaaacgatgacgctatccgcgctgttcgtttaatcacagctaaaatggctgatgctatcatcgaaggccgtcaaggtgaagatgatgttgaagaagctacatttgctgcagaaaacaaatcagcagactcaatggaagaaatcgttgaagcagttgaaggcgacaacgatactaacactgacgctaaatagtagattcaaataagctgtcttagaggtttcgcaaatactgcctgacttgtgggacagctttttttaaaccaattatattgaatataaattgtcggaggtatggattatggctgaaattaaagctgctcaagtaatggaattacgtaagaaaactggcgttgggatcatggatgctaaaaaagcccttgtagaaagtaacggcgacgttgctcaagcaatcgatgctttacgtgaaaaagggatggcaaaggctgctaagaagagcgaccgcattgctgctgaaggtttagcaggcatcgccatcgatggtaacactgctgcaatcgttgaagtgaactcagaaactgacttcgttgcttcaaacgatcaattcaaagctttattgaaagatattgctgaaacaatcgctaaaaacaaaccagctgacatggctgctgcagaagcattaccaatgggcgaaggcacaattgctagctcagtaatcaacttaactgctgttatcggcgaaaagatcagcttccgtcgttttgaattagttgaaaaaaatgatggcgaccactttggcgcatacctacacaatggtggccaaatcgcttcattagttactttagaaggtgctgacgatgaagcagctcatgacgttgcaatgcacgtttcagctgttaaccctcaatacgtttctcgtgaagatgttcctgctgaaacattggatcacgaacgtgaagtattaactgaagaaacaaagaacgaaggcaaaccagaaaacatcattcctaagatcgttgaaggccgtgttaacaagttcttgtcagaaatcagcttgaacgaccaagctttcatcaaagactcagatcaaactgttgcacaatttgttgcatctaagaacggtagcgttaaaggtttcgttcgtttcacagttggtgaagggatcgagaaaaaagaaaataactttgttgatgaagtcatgggccaaatcaaataagcttattttgcttcaaaaagggaacgcaatttgcgctccttttttttgcagttttacgataattcagaatcgcatacccaaataacttattaaatatggtaaaatgagcctagtaatcaacggagggatatcaatcatgtcaaatacaaaatacaaacgcatcgtcttaaaagtgagtggtgaagcacttgctggcgaccaaggtttcggaattaaccctgaaattgttaaagtagtcgcaaacgaaatcaaatcagttcacgatttaggggttcaaattgccattgtctgtggcggtgggaacatctggcgtggtgtgactggtgaacaaatgggcatggaacgtgcgcaagccgattatatgggcatgatggcaacggtcatgaatgctttagctttacaagataacttagagagcattggtgtcccaacgcgtgtgcaaacatcaattgaaatgcgtcaaatcgcagaaccttatatccgtcggaaggctgttcgtcatttagaaaaaggccgcgttgtgatttttgctggtgggacagggaacccttacttctcaacagatacaacggctgcattacgagctgctgaaattgatgcagatgtgatcttgatggctaagaacaacgttgatggtgtttactctgctgaccctaacactgattcaagtgccgttaaattcgacacattaacacatttagatattatcaacaaaggcttgcaagtgatggattcaactgcaagtactttatcaatggacaatgatatcccattggtagtcttcaacttaaacgaaccaaacaatatcaaaaaagttgttgaaggtgccaacatcgggacaacgatcgaaggaggagaataatatggcaaatccaattttagatgaagcaaaagcaagcatggaaaaagcagaagcttcattacaaagaacattaggccaaattcgtgctggtcgcgcgaatgcaagcttggtcaaccgcgtgaatgttgagtattacggtgcaatgacaccacttaaccaaatcgccgcaattacagtcccagaagcacgggtcttgttgattaccccttatgacaagggtgcgcttgaagatatcgaaaaagctctttatacagctgatttagggatttcaccagccaacgatggctcagtaatccgtttagtaattccacaattaactggtgaacgtcggaaggaaattgctaaagaagttggtaaagaagctgaaatcggcaaagttgccatcagaaatgcacgtcgtgatgcaatggacagcttgaaaaaagctgaaaaagcaagcgagattagtgaagatgaaatgcatgatttagaagaacaagttcaaaaattgacgaatgaagcaacgaagaagattgacgaaatcgccaagaacaaagaaaaagaaatcacagaaggttaatccctaatggatgcaaaaagccccgccacaacagtggcggggctttttttgcgttaatgaataattttactcttcgtcgcttctttgtggagtttttcaaagaatggattgattcgatctttcaggaagaggccaattaggaagaaaacaaccgcaaagagcgctaggatgataaagttatgccagaggttcggtgcgtaaatcccaccagttggttcgcgtaagaggttgaccccgtatttgaacggtaaaatggggttaataaactggaagaattgatcggagaggacaactgggaagttcccgccaccgccagagatggaaagcaccaagacaatcatcgcaattcctttaccaacgttcccgaacatcgcggcgagaacgtaaacaattgtcatgaagaccatgctcaggaagacggctaataagattagcggtagtttatcaacgatgtaggccttcaataagaaaatattaccaagcgtcacaatcacggcttgggcgacaccaatgacgatgtaggttagccagcgagcaataaattgctgtttcttagtgtactgtttcttttgtttgtcgtctaacgcgaagttggttaagacgatgttactcaaaagaagtgcaccaacccagagacaaagggctgtgtagaacggcgcacttgctgagccataggtcttaatcgggtagacgtgtttttctttcagttcaaccggtttggctaagaaattactttccttagttgcatcgcggcgaagcaatttaatcagatctttgagatcgaccgtcttttgttgtttgcgaatcgcctcagcgcctttttggatcccgctacgtaagaatggccaatcattgttgatgaggtcggtcgcatcatttaaggcggttttaacgagtgggaatttctcgttggccatgttgagcgtcgttgttaagtcgttttcgatgcctggtaagtcattgttgatgaaactggttgccagttgcagtttatttttgagtagtgggtaatcattctggtaaacgtcagaagcggtgtttaatccagagataatcgtgcccatattgccatttaataatgtattcgcgtcatgaatttcttgtttcaacgctggtaactgctgagcatatttttgcagatagtcgatggcttgttggagcgtcttttgtgtgttgaataagagtgcggggagtttcggtaaaacttcgccgttaagctgtgttaagacggcgttaccgctagcaattaatgttgaaaagcggtcgagcatatttttgacgctgtcaccgatatgggccgcttgaatcttagcgacgctgtcttcgacttggtcggcgtattgaatcaaaccattaatcttggtttgcaaatcgtcaattgataaatcatcgtaatgggcgagaaggtcatcaacttggcctttaaaaacgccgagttgggtcgccaacgtatttaaatgtttaatcggtgtatcaagtgcatgtgattccggttgaccattcgccactgctgactgattgtagctgtcttgcaagttttggagggttgtcgcaagttgagtcgcatgggtttgcaaggtagcggtatgatcatataagttctggagcgcttctttgagcgcttgcttgagttcagcattattgggatcctctttgagttgactcagcaaactattgacggccgttaaattagttgaaatgttagttgccaattgattggtaatggctaacccttgatccaccgttttttgaatgaccggtaaagcagcttggagtttagggattaagtctgattgtaattgatccgcgacaccttgggccgtttggctaaaagtcattaagtccggtaagactttttgtgttttgtttaacacatctaaaccagtttgagcttcgttaatgccgttcgttaaagtattggcgatgccatcgaaatcagaatcgagtgtggcaacttgtttgccagcactttggatttctggaatcttagcctgaactttcgttgcgagctgaccggctgcttcaacttgtggtaagtattgattgatgccgactactttttgcgccatggcatttgcttgtggtaaaaaggccgcgaactcgttggcttgggcaagctttaatgccatttccggtagtttcttttgtagattaagcacttgttctgcgtattggttaatttctggaatttgttggtctgttttgagaatgaggctcgagaaacgattaatgacggggagatttgtattgagatcaatcccggccttgtttagggtactcatcaatgttttaccaacggttgagacgaattcttctgaaatggtggactgaagcgtagttgcacccgcactggtaattttaggcgcaatcgcgttaatcttatcattagatgagtagactatctttggcttttgaatcttgccatcgacgaaactaacgagatcctttgagaagtttttgggcacgtaaatcccggcgtagtatttccccgtttttacgccgtcatctaattcttttttgctcgaagtaaattgccagcctaatttgtcatttttctttaattggctaattagttcggcgccaatctcgacttttttgtcagcaatgacaacactttgatcggctgagtaaacagcgacttttaagtcttgcgttttactataagggtcccataacgcccagatattaaaccacgcgtagagcgatggaatgataatgagggcaataattaatagaagagcgatcgggctttttaagattcgacgccaatcaagtcgaaagagttcgaaggtttttcgcataataaactccctttttctgtttaaggtatgtattagtttatcatatttaacctgttacatgccaataactataggaatctactaatatttaacaataaatttcaatgtgatagcggcaacagtacgttgtggcgggaatcgttggtattaaaggcttaatcgtggataaaaatcatctgggaagaactcaaaaagtgcagaatgggcggttcagtttgtacaatgccggtgacaatcggttgattttaaatagtcacttcctgtgatttttggtacaatcatatgagagttattgaaactggaggagtatgtggtgtttacaaataaaaaaacagacgcacaacaactagatcccaccaatatccccaaccacgttgccatcatcatggatggtaacggtcggtgggcgaagaaacgcttaatgccaagaatcgctgggcataaagcaggaatggaaaacgttaagacgattaccaaaacggccagtcgaatgggtgttaaagtcttaacgttgtacgctttttcaactgaaaactggaagcgtccaaatgacgaagtgaacttcttgatgcagttaccggtcgatttttttgatacgttcatgccggaattgattgctgaaaacgtccgtgtgaaagtcatgggtaatattcaagaattaccagaaaagacgcaaaaagcggctaacaatgcgatggccgatacggctgataacacagggatgattttgaactttgcactcaattatgggtcgcgtgacgaaatccaacaagcggttaagcaaattgctaaagatgcggtaaatggtacaattgaggtcgatgcaatcgacgatgcgttgattagtgattacttgatgactggctttttaggggaatatgctgacccagaattattgattcggacgagtggcgaagagcgaatttcgaacttcttactctggcaaattgcttacagcgaacttgttttcgtagatgaattctggccagactttaccccagcagtgtttgaacgctcaatcggcgcttaccaaaaacgtaatcgtcgttttggcggtcttaaataggaggaaatacaattatgaaacaacgtgtcattacagcaacaattgctttaatcatctttatccccatcattttctttggtggtatttacattgatatcgcggcagccgttttagcactcgttgccttatcagaagttttcatcatgcgtaaacgaattattgtctcacctgatgcaaccatcgccggactagcggtgttaagtttagcctcacccaaaggcgcctttaactggttaccagcaggtgtgtcacaatttgatttattctacttcttcgttgccattttattagccatcacagtcttcacgaaaaaccgggttaacttcgatgatatgggtgtcacaaccttagccagtctctatatcggcttaggcttccattatttagccgcaacgcgaaatattggtggttttgacactgtgatgtatatcttattggtcatctggatgacagatatcggtgcctacacattcggacggatgtttggtaagaataaaatgtggccagctatcagccccaataaaacttgggaaggttcaattggcgggacattatcagcattagtggtcgcagctatttatttaaacttcttcccacaagcttattcaatgcctgtcatgttaggtttaacgttgatcttctcaattgccggtcaattaggtgatttagtcgaatcagcttacaaacgctattatggcgttaaagactcaggcaaaatcttaccaggtcacggcggcatcttagatcgctttgacagcatgttgtttgtcttaccgctactacacttgtttggcatggtttagagtgcgtttgtggcgtttaacttctgaggatagtctagtcgggcgaatgaccaacttgttggtcgtttgacagacgtagctagacggaagaagttgccaaaaaaagcacgttttaaaataagagtgcgtttggttgcggttagcaactgagcattaatacaaaaattcgaataatcccggtttcaggattatttgaaattttagattaagcggaagttgttgcaaccaaaaagcacgtttttaaaagtcaatattatctagcgtttagcgcaactttttggtttgcgctaaacgcttttcttgtttctaaggaattcgtgatataatataacagttcatatcaaatgagagtattgaaatacgcatttagaagggagtcgtactctattggcggcgattattgcgtttattatcatatttggcattttagtagtggtgcatgaatttggccacttttacatggcgaaacgttctggtattttggtgcgtgaattttcaattggcatggggccaaaattatttgcaacgcgcaaaaatggcacgacttatacgattcgttggttaccacttggcggctatgtccgcatggcagggatggcggatgatgaatctgaaatcgaagccggcacgcaagcaaccttgctgttagacgaacaagaaactgttcaaaaaattaatacaagtgacaaagtaaccacgttaaacggtgtcccatttcaaattgcaaaaactgacttgcaaaaagaattatggattgaaggctatgaaagtggtgacgaatccgaattaaagcgttattcggtcagtcacgatgcaacgattgttgaatcagacggaacggaagtgcaaatcgcacccgtggatgttcaattccagtcggctagtttaatcaatcggatgttgaccaacttcgcaggaccgttcaacaactttatccttgcgattgtggcgtttgcgctctttgcttttttaaacggtggcgtcccacaaaacaaagcgattgttggcacagtgatgccaaactcgccagcacaaaaagccgggcttaaaacggatgaccggttagtgaaagttgctggcaaaaaagtcacgacgtttactgatttcagctcggtgattgcaaaatatccgaataaaccagtgaatgtccaggttaaacgggcaaagcaaactaagtcactcgaaatcacacctaaagcggtgaaagtcgagggacaaaaggggaaagtcggccaaattggtgtgacagctggactcaaccatagcgtgggggctaagttgaaatatggcttcacccaatcatgggcgaatgcgacccagatttttaaaattctcgggtcattcttaacgggtggtttttcactcaataaactagccggaccagtcggcatgtattcaatgacgacgcaattcgcgagtcaaggctttacaatgctcgtctacttcttagcgttcttatccgtcaacttggggattatgaacctgattccaattccggccctcgatggtggtaagctcgtgatcaacgtgattgaagcgattcgcggtaaacccatctcaccggaaaaagaaggcattgtcacccttgtcggggtcggcatgatggtcgtcttaatggtcttggtcacatggaacgatattcaacgctttttcttttagattatttttggaggtataacagattatgaaacagtcaaaattatttatcccaactttaaaggaagtgcctaactcggccgaggctaagagccatcggatgatgttacgggccggctatattcaccaagtatctgctggtgtttacagttacttacctttagcattccgcgtcttggaaaatatccaagccatcatcaaagatgaaatgagcaagattgacgccgttcaaatgcaaatgccagggattttacctgctgaattgtgggaagaatcaggtcgttacgaaacctatggcgataacttattcaagttcaaggaccgtcatggccgcgacttcatcttaggcccaacacacgaagaaactttcgctgacttggtgcgcaatgaaattaagtcatacaaaaaattaccattaacgttatatcaaatccaaacgaagtatcgtgacgaagatcgtccacgttatggtttattacgcggccgtgaattcatcatgcaagatgcttattcattttcagccaatgaaactgatttggatacgactttccgccaaatgtaccaagcatacaccaacatttttgaacgctgtgggttagacttccgcgcaatcgttggggatgccggtgccatgggtggtaaggattcaatggaattttctgcgattgctgaaattggggaagatacgattgtttattcagaccaaagtgattatgctgccaaccttgaaatggcaacgagtatccgtcctaagcaaaactcaagtgatgtgcaattagagcttgaaaaagtagcgactggcgatgcccacacaattgaagaagtggctgctaaattagacgtcccagcacaacaaatcatcaagagtgttctctttatcgctgacgaccaaccggtcttggtcttagtgcgtggcgattttgaagttaatgatgtgaagttgaagaacttcttagatgctgatttcttagaaatggcaaccccagaacaagtcttagcaacaatgaacgcaccaatgggttcaatcggaccagttaacgcgccagaagacttacaaatcgttgctgattacagtgtcgaagccatggtgaatgccgtggttggggcgaatgaagccgatcaccatttcacgaatgtcaacagcaagcgcgactttaccgtagctgattattcagacctacgtttcgttcaagaaggcgaaacatcacctgatggtcaagggaacttgcactttacaaaggggattgaaattgggcatatcttcaaactaggcacacgttacactgaacaattcggtgccactttcttagatgaaaatggccgtgcgaaaccaattatcatgggttcttacggaatcggtgtgagtcgcctcttatcagcgattacggaacaacaagctgacgaaaacggcttagtttggccaagcgcgattgccccttatgacttgcatgtcgtaccggtcaatgtcaaagatgctgaccaagtcttattagctgaacagatcgaaaacttacttgaagaagcaggttactcagtcttagttgatgatcgtaaagaacgggctggcgttaagtttgccgacagtgacttaatcggcttaccaatccgcatcacagttggtaaaaaagcagcagaagaaatcgtcgaagttaaattacgtaagacgggtgaaaccctagaagtgaagaaggatgaattgattaattcattaggtatcctattggcttcagagacaacagaagctgaatagagtgcgttcaagctcggtcaacttttgagcattagcacagggaagcgaattaacgacgcagtcgataatttgattcccagcgctaagcgcagaaagttagcttgaaagcacgtttaggaatagagtgcgtttgaaaccgtttggctccaagcattaacttaaattcgtgaatgagcgacaacgtcgatcgttcgcggattgtagttaagcgcaagaggcagtttcaaaaagcgcgtttacattataaatgttcggacatctaaaaagggctgagacagaatgatatttgtcctagccccttttatttaactttctgaatatgaggaggcccttttgtggcattagatcaaaccgcactgtttcaaaaattattagaacaaattgatttacccgcggatgttgcgaattatcctggcttcaaaactggccaagtagaacaagtcgttgtccacgaaacatccaaacggtggacttttaaattacatttcgaatccgttttgccatatgctgtttacacaacgtttgaacagtatctagaagcagccttcaaatcaattgcggatatcgcggtcgacatttcgaccgatgcaactgaattagacggcggtgttttagcagcttattgggaatacgtcatcaaccatagtgggattcaatcttcaatgttgcacgaattgtgtgaaaaagagaccccctatatcgacggtcgcaacgtctttttagttgtcgaaaacgacatcgtgaagatgttcttcttaaatcaagcgcaaacgacaatccaagctggttatcaacggcttggttttcccaagtttgcgattcaacccttgattgacgaatccgcctcacaaaaggcaatcgaagattttcaagcgaagaaggctgaacaagatgcagcccgcgcacaagcggcagccgaagcgatcaagaaaaatgaagcactcaaagaaaaacgtcaatcagaaggcaaaccagtcgatggcccgatttcaatgggccgcggcttaaatcctgctgaaccaacccgtcagatgattacaatcaatgaagaagaacgttccgttgtcattgaagggttcgtctttgataaagaagtccgcgttttacgttctggccgccagctcttgattttgaagatgacagattactcatcatcatttacggtcaagaaattctcccgggataacggcgacgaaagtatcttcgcagccatcgataaaggcatgtggttcaaggtgcgcgggagtgttcaagaagataacttcatgcgcgatctcgtggtcaatgccaatgatttggtggaagttagccatcccaaacgccaagataccgctgaaaatggtaagcgcgtcgaactacatttgcacaccaatatgtcacaaatggatgcgaccaacaagattggcgacttcgttcaacaagccgctaaatggggccaatccgcgattgcggtgaccgatcattataacttacaagctttcccagatgcttatgcagcagggaagaagaacggcgttaagattttgtacggtgtcgaagtcaatttagtcaacgatggcacgccagtcgcgtataacttgcgcgatgaagcactcgaccatgctgaatacgtgattttcgatgtggaaacgactggattgtcagccgtttacgattcgattatcgaattggccgctgtcaaaatgaaagatggcgaagtgattggctcgttcgatgaatttattgatcccggtcactcgctatcagctttcaccacgcaattgacgagtatcaccaatgaaatggtgcacggtgctaagaaagaagccgaagtcctagcgttgttcaaagaattcgcgggcgatgctgtcttagctgggcataacgtaacgtttgatatgggctttatcaatgctggctatggtcgtaacgacctcggtcagattgaaaatcccgtcatcgatacgttggaagtttctcggatgcttcatccagaatacaaaaatcataaactcgatacgttaaccaagcggtataaaattaacttggaacaccatcatcgtgctaacgccgatgctgaatcaaccggttatttgttatacaaattagaaaccgaagcggccgagatgtatgggatggtcaacgtcaatcaactgaatgatcgcgttgggattggcgatgcgtataaacaagcacggccagcgcatgcgattttaatggcgcaaacccaagctgggttgaagaacttatttaaactggtttcagcatcgatgaccgaatactattatcgcacgccgcgtttgccaaagagtcgcttggatgccttacgtgaagggatcttagtcggttcagcttgtgccagcggtgaagtcttcgaagcgatgatgcaaaaaggctaccaagaagcacgcgatcgcgcgaagtattacgattacctcgaagtaatgcccaaagccgtttacgcaccattattagaacgtgaattagttcgcgataatcgggcgcttgaagaaatcattcgcaacatggtcaaactcggtgctgaattggataaaccagtggttgcaactggggatacccattatttgaatccagaagattcaatctatcggaagattttgattcactcgatgggtggtgccaatccactgaaccggtcacaattaccggatgttcatttcagatcaaccgatgaaatgttgacggcgttcgattttcttggtgccgatattgcccaagaactcgtggtgacgaatccgaaccaaatcgccgatatgattgatgaaatcacaccggtcaaagataagttgtacacgccgaagatggcgggtgccgaagatgaaattcaaaccttaacgatgaatcgtgcgcatgaattatacggggatgaactccctgaaatcgtgcaggcccgccttgataaggaattgaagagtatcatcgggaacggtttctccgttatctacctgatttcgcaaaagcttgtgtataagagtggtaaggatgggtacttggttggttcccgggggtccgttgggtcgagtttagtcgcaacgatgaccgggattaccgaagttaatccattgccgccacattatcgctgtcccaactgtcattactccgaattttataccaaaggggaagtcggttcgggttacgatttagccgataaggactgccctgaatgtgggacaccacttgataaagacggccatgatattccatttgaaaccttccttggcttccacggggataaagtgcccgatatcgatttgaacttctccggtgattaccaaccggttgcgcataactacaccaaagtcttgttcggggaaaataacgtgttccgcgctgggacgatcgggacggttgctgataaaactgcctacggctatgtcaaagcctacgaacgtgataccgaacaaactttccgcggcgcagaagtcgatcgtcttgccaaaggctcaacaggcgttaaacgaacgaccggtcaacatccggccggcatcattgttgtgccggattacatggacatctatgatttcacaccaatccaattcccagctgacgatcaagatgcagcctggaagacaacccattttgatttccattcgatccatgataatatcttaaaactcgatatcctgggccatgatgatccgaccatgatccggatgctgcaagatttatcggggattgatcccaagacgattccaaccgatgatcctggtgtgatggccttgttctccggcactgattcactcggggtaacgccagaccagattaattcgaaaatgggcacgctcggtgtaccagaattcgggacgcggtttgtccgcggaatgctcgaagaaacgcaccccacgacgttctcagaattactgcaaatttctggtctttctcatggaaccgacgtgtggttgggtaatgccgaagaactgattaacaaaggcgttgtcaccctaaaagacgttatcggttgtcgtgataacatcatgatggatttaattcactggggtatggacgatagcatgtcgtttaacatcatggaacgggttcgtaagggtaaagggattccggatgactggcaacaagccatgcgcgacaacgaaaatgtgccagactggtacattgattcctgcctgaaaattaagtacatgttccccaaggcccatgcgaccgcctatattttgatggcgttgcggattgcctacttcaaagtctacttcccaattatctattactgtgcttacttcagtgtgcgtgccgaagatttcgacctcgtggccatggcccaaggaaaagaaggcgtcaaagcccgcatgaaggaaatcactgataaagggatggaagccagcaccaaggaaaagaatttgttgacggttctcgaaatcgccaacgaatgtttggaacgcgggattaacatcaagatggtcgacatcgaaaaatcagattcatctgacttcttgatccaagacgaccacaccttgcttgcgccattccgtgccgtcccaagtctgggcggtaacgtcgccaaacaaatcgtttccgcccgcgaagaaaagccattcttatctaaagaagacttatccaaccgtgggaaagtttccaagacactgatcgaatacctaacagaaaataacgtattgaatgacctccctgatgaaaatcaattgtcgttgtttgatatgatgtaaattaaaaagcctttgatttttgccagaagtttgtcggaaatcaaaggctttttttattgtagacaatttttagtttagctaggttgcgaatataaagtaggtaagctatccttttgaagacgatgtaaaacaattattttgaggtgactttatgacaattgaggaagtattggtaaagctaaagcaggctgacttagatacggaatattcaaagaagatttttgagagagaagaaggtagggaagatagtaccctaaaaaaaggtcggcgtgattggatattgatttcggaaatatatggttcaaatcactgtagccaacggttccatttagagaattacttaaaatttaagttacatgatggtttaaaagagtctgatcaatttgaaacaaaatgttattgctatattcgaaatgttgctttgatactctacatttagagaagttatttttgatgaaaggaaagaagatttgaaacttttatttctatctaaagtgatagcgatccttttttaatccataatgcccgtggcaggattcgaacctgtacttggttacccaaacagcgacctgaacgctgcgcgtctgccaattccgccacacgggcgattgtgctacaagactattgtaccagtgttacagagccctgccaatacccatttattaatatttcgcttataataatagttgataagggagggattcagatgcaagtcatcacaaattcaaccgttcgtgcggtcctgcaggcacggcctgccatcagtcataaaggcgattttggccgcgtcttaatcattggtggtagtcagcaatacggcggtgctgcgattatgagtgcctctgcggctgtttatgctggtgctggattagtttccgttgctagtgacttaagtgttctcagcggactgcacgcgcgcttaccagaagccatgttcattgattatcaacaacccttcgtgcagtggtcgtctgcagtccaggctgctgatgtcgttgttgtcggacctggtcttggcattacttcgtttgccgttgaactgctgagaaaaatcttacaaaccatccaaccaacacaaacactgattatcgatggttcagcactatcaatcatcgcacatgaaaaactgacgatcccgaatacgcaactcattttaaccccgcatcaaatggaatgggcgcgcctcagcggtgttgcaatcgagcagcaaacggttgctactaatcaagccgcactcgctgcttatccaaacgcgactttagtgcttaaaaaacatcacactgaggtctatcatcagcaacaggttcagcaactaaccatcggtgggccttccatggcaactggcggtagcggcgatacactgactggtattattgccgcattctgtggtcaatttggcacccactatcagacgatttgtgccgctgtttatacccacagtgcgattgctgatgaactcgccaaaacccaatacgtcacacttcctagccaagtgattcagaccttaccacactatatggctaaaatgattcatcaatctaaaaaaaaacagcagtccttttgaaagggctgctgtttattaattcgctttaagtaatgcaagttctgcatctgtcaacgcacggtattggccacggtctaaatcatctggcaatgccagtggtcccatctcaagccgttctagcgtcaagacttccttgccgaccgcatgaaacatccgcttcacttgatggaatttaccttcatgaatctcaacggtaatctgactttcttgttgcgcctcatcaacactcagaatttcaagctgtgctggttgtgcagtaaaatcactcaacacgagccccgcttcaaaccgcgcttgatcctctgccgtgacaatcccggcaatcgtggcgcgataaaccttgctgacgtgttttttaggactcaacaaggcatggcttaaatcgccgtcattcgtcaacaataataagccggttgtgtctttatccaatcgccccactggaaacagatcatcccgcaagtccgctggtgccaacaaatccaacaccgttttctggggatcagtcgtcgccgaaatcacacccgccggtttgttcatcagccaataaaaataggtttgataacgcacgggttcgtcgtcaacatagacaacggtcgcctcgttcactttgaacttcgcatctttgaccacagtcccatcaacgcgcacgcgtcccgctttaaaaagtacctttaattctttgcgtgaagccacattcatatgacttaaaaagcgatcaattctcatttgattctcaactttcttctaaaccgatccaagttactcccaatgacatagtccgctaagcgcgatttaagcaccaatgcggcgtaaacagccacacctaggccaacgctaatcattaagactagaacgctctgaagacggctgtacgggttaaagacaaggtataaccccttgactgcccccgccgttaccaaatacatcaccaatgagaagcctaaaacgccgattaagcgccgaatggttttgcgtaatgcaaagtgataatagcgatgcagtgctgcaatcattaaaaccgaacttgtcgcaaaggctaagccggtcgatactagcgggccatagacacggaaaaaataaatcgctgggtactgcgccacaattttgacgatgaatccgatgaataagtaaaacaatgccaagcggttctgatagaggccttgtaagacagcgcctaaaaccgtaaagaggccgagcataatagaaatgtaagatgaaaattgtaagacactaatcccaagcgtatcatgcgcgtagaataacgtgtaaagcggaccggcaaccgccgccatcccaaatgccgctggaatcatcactaagttgaataattgcaaagtactgccgatttgatgttgcaattctttttgattgccccgcacatgcgcagctgacatcaatggaatcgccgtgaccgccatggcagcagcgagtgaaacggtgattgaaatcagtttattcgcattagctgcaaataaagcatacaagttatacaactgatgatcactggcaaccacgaaatcatgcatcatcggattaaacgtgtattggtcgatgatatagaccaagttgacacttgcgtcgattacgatgaatggaattgattggcgcacaatcccttttaacaagtcagtcgttgacacttctaattcgttgttactattggccactaactctgaaatgcgaccgcgttgtttcaaataatagaaaatcagtaataacaagccggcagcagccccaatgaatgcggcaaatgtcgcctgcgtcacagcatccacgtagctgcctttaaacacttgcataatcataaaagcggtcacggtcatgtacagcacgcgggctgcttgttcaataaattgcgaaatcgcagacggcgccatttcggcatagccttggaaaaagccccgcataatactgagcaatggaataatcaatagcggccagcttaatgaccggaagaccggtaccatccgcggatcacccgctgctagaacgggcgctaacgcaaagagtgcgagcgctgataaaacacccattgccaacattaaaatcagcgactttctgaaaagacgctgaccaatgccatactcattcatttcgttatagcgtgcaatttgtttcgatagcgcccctggaatcccagccgtcgagatcactaaaaagacactataaatttggtatccttttgcaaataatgtgttggcctgtaagaaattcgcgccaaaccagattggccacggaattacatagacggcgcccagaattcgcgagaaaatactcccagcggtcatccaagcggagccccgtaacatcttactttgtgaagatctatccgtcgcctttgtttcaggtgaattggtcatttcccataactcccttattaaacgtcaaaaagcatcttcctaccattttagaggattgccccaagccttgcaattcctttaacaaaactttatgaaaaagagtgcttctgatgacggttagcaactgagcattaatacaaaattcccaataatccaggttttaagattattgggaattttagattaagcggaagttgttgtcatcagaagcacgtttcaataagagtgctattagcgcttgcccagattttgagcactaacctaaaaacgggaattatggcgtactcggccatgattcccgttttgtagttaggcgcagaaatctagcgccaatagcacgtttcaaaaaaagagccccgccttcgcggagctctctaccatctcattatttagcttgtttactttgttgaatcaaataccacgtcaacagaatgctgacaaaaaccatgataccgccaaagattggtgtactgtctaagccccaagctgccgatgcttgcccgccaactaatgagcctatcgtaatcccgatattaaaggctgagatattcaaagccgaagccaatggaatatcatttggcgtgattttttcagccaactgcacaatgtataattggagccctggaacgttcatgaaggcgaaaaagcccatcaataaaacgttaattaaaccgaaccaatgggcatttaacgttaacatgaatagcaacaaggtcactaacaagccaacaaacattttcaatagcgccatcaacggttggtgatttgaccatttgccgcccaacgtatttccaaaagccaccatcagaccataaataattaagatgatcacaaccgcacttggtgaccaacccatttttgattctaaaatcggcgttacaggcgaagactggcgcaaaagcgaccgtcaagttaccaatgataaagacaaccataatccccgacaataaatttttccgtggccaacgacttgttaaaatcgccaaaatcggtgccccaatcgtaattcccaaagcatacatcgatacggttagtcctgcttgactcatcgtaatcccaaaacccttaatcatcaatggcattaagccgacactgatgaattctgtcgaaccaatcgcaaaagcactgattgccaatgctagtaatgtgaggttcgcccgttgtttactactcatactgccacactcctattagactttttttactgatgtactatattattcaataggagcgtcattttcacaatcacgcactttttagtcagtaggttactgaaaagtaataattgagtcttatcacaatgaaaaggtgaatcaaaattagaaatgaatgagaaaacatataacattggcgttgaagttacgatggaaattatcggcggtaaatggaaacccgttattctttgtcattttcgcaaccaaccacggagatcaagcgagctcttacaacgcatcccaaagatttcccaaaaggtgctcactgcacaattacgcgaactcgaaaacgatggcatcatcaatcgtaaaatttatcaagaaattccgccacgcgttgaatacagcctctctgaatacggtcagtcactcaataaaatcttaaatctcctctgtttatggggcgaagataacactgatcgccgccaaacagcgggtgaatcaatcactgttttacatcgcgatcaaatcaatccaatcgaataaaaaaaagacagccaactaggctgcctttttgcttgtcatgatttttgccgaccaaatttcacgaaataaataaccaccatgatcattaagaaaattaaaccaacaatgattgaaatccgcgtttccggattaatgaacatgaaaactagtgtcacacacaacattgccaaagtgatgtaattggaatagggtgaccaaggcatcttaaatggatgttgtgccatcttgtcagcgtgttgctttctaaaggcaatttggctgatcaaaatgacgaaccatggcaccatccctggtaagacacttgaactataaacgagcacgaagacattgccagcttttggataaacaagtggtaaaatggcgtttaaaatcaccccgattaaaatccctaatgaaatcgccccgaccgcataaaatgggacaccgtggcgatttaattttaagaatcgttttggtaactgcccattattggccaacgtgaacgtcattcgactagcactataaatccctgagttagcccctgacaaagctgctgtaatcactacgaagttaatgattgatgctgcagcggtaatcccaattttagcaaaggtttgcacaaacggtgaaccgacctgactcaattcgttccaaggataaatgctcaagatcacgaaaatcgccccaatatagaaaatcaaaatccgtgcaaccgttgattgaattgctttgaccaatgttgattgtggattttcagcctcgccagccgtaatcccaatcaattcaatcccttgataggatgccaagacaattgccaaggcaaagatgaagcctttaaagccacccgtaaagaagccgtgcgtccataaattactaatgccaactggatgcatatggttcccaatcccaaaaacaatgagacccaggcctgccacaatcatcagaataatcgtgacgactttaatcaacgcgaaccaaaattccaattcaccaaacatgctgactgaaattaagttagccgcacataagaacgtgatcgcgaccagtcccggtacccagcccggcaagttcggccaccagaattctaagtaaccgccaatggcaatcatttcactcatccccacgacaacgaattggaagacgttgctccaagctgttaagtaaccaaaaatcggatgcatatattccgttgcaaacttggcaaaggaccccgtatctggatcaacatacagcatttctccaagtgcacgcataatgagatacagcaataaaccagcaatcccatacgcaatcagcacagacggccctgtccatttaattgtcgtgttggcccccataaaaagcccaaccccaattgtcccgccaagtgcaatcatctgcatctgacgggcagttaaatttcgtttcatagtcctcaaacccctctattttagcatcatcattattggttaaccccagaatctaaatttacttatcatcgtataataaaaaacacccaaaagcaatagtcgctctcatctttttatcatcttaaaagcgctttagaataacccttatattaattgaaggataattaggcccctaaacattaattttaaataagaaaaagcagttactgcgagaaacagtaactgcttttttgaaacatgctttttggttgcaacaacttccgcttaatctaaaatttcaaataatcctaaaacctggattatttgaaattttttattaatgctcagttgctaaccgcaaccaaacgcactcttgtctgaaacgtgcttttcaagctaactttctgcgcttatcccagtgaatcaaacaatcgactacgtcgcttattcgcttccctctgataatgctcaaaagttgaccgagcttgaacccactctttttgaaacgcactctaattggcgacgatattgaccaatttatttggaatggcaatcactttgcgcaccgtcttgtcagcaatgaattcaactactttttcatttgccttagccatcgcttctaattcttccttcggtgtgtctttagccactgttactttggcctttaacttaccgttaacttggaagatcacttccacttcatttgcaaccaatgctgctgggtcaaatgttggccagtccacgtaactgattgagccatcatggccaagcattgcccataattcttccatcatgtgtggtgcaattggcgctaataacttcacaaagccttcagcgtattcacgtggtagtgtgtcagccttataagcatcattgatgaagaccatcaattgtgaaatggccacgttaaagtgcatgctttcgaagtcttctgtcactttcttaacagtttcgttgtaactcttcttcaattgttcatcattttcagcgacaatcttgcttgaaagttggtcgttttcgtcggtatcttcttctgtatatagacgccatacccggtccaagaatttacgcgcaccggctaagcccttttcactccatgaaatggaagcatctaatgggcccatgaacatttcgtataaacgtaatgtatcagcgccaaagcgattgacaacatcatcagggttaacaacgttcccttttgatttcgacattttttcgtggttatcgcctaaaatcatgccttggttatataggtgttggaatggttccttcgttggcacgaccccgatatcatacaagaacttgtgccagaaacgaacatataataaatgaagcacggcatgttcagcaccaccgatgtacatatcaactggtaaccagtctttcaacttatcaaagtcagccaatttgtctgggttcttaggatcgatataacgaaggtaataccatgagctaccagcccattgtggcattgtattcgtttcacgacggcctttgcgcccattttcgtcggttacgtttaaccagtccgctaagttcgcaagtggactttcaccagtccctgaaggcttgatatcacttgttaatggtaattcaagtggtaattgagcttctggcaccactgatgttgtgccatcttcccaatgaataattggaatcggttcaccccagtagcgttgacgtgagaataaccagtcacgcaacttgtagctcacttgttcatgaccagcattatgcgctactaaccaatcaatcatcttgtcgattgctgcttgtttgtctaaaccatcaaggaaatctgaattaatcatcacaccaggttctgtgtgaacagcttcttcaggattaccaccagccacaactggtttcaatggtaagtcaaatttcttcgcaaattcccaatcacgagggtcatgtgcagggacagccatcacagcaccagtcccgtatgaggctagaacgtaatctgaaatccagattggtaaccgttcgccattgactggattaatggcgtaagcacctgtaaaggcccctgttttatctttcgccaaatcagtccgttcaagatcactcttgtgttcgatttcttttaaataagcatcaacagctgctttttgttcaggcgttgtgatatcggccactaatttatgttctggggccatcacgatatagctgacaccaaacattgtgtcggcacgcgtggtgaagacatcaatctgagcgtcatggttttcaacagcaaatgatacttcagcgccttttgagcggccaatccagttgcgttgcatatctttgacactttcaggccaatcaactaggtctaagtcgtcgattaaacgatcggcataagccgtaatcttcaacatccattgacgcattggtttccggtaaacaggatagccaccgcgttctgttttgccgtcaatgacttcttcgtttgcgacaacggtccctaaatcagggctccagttaacagccacttcagcttcataagctaagcccttttcgtacattttttcaaaaatccattgggtccatttgtagaaatcgggatccgttgtattcacttcacgatcccaatcgtatgagaagcctagtgaattgatttggcgtttgaacgtattaatattggtttgcgtgaaatcagcaggattattcccagtatccaacgcatattgttcagcaggtaagccgaatgcatcccaacccattgggtgcaacacgttgaagccttgcatccgtttcatccgggccaagatatcagttgccgtataaccttcaggatggccaacgtgtaagccttgacctgacggatatggaaacatatctaatgcatagaaatttttcttatttttatcttctgttgttttgaacgatttgtgtgattgccagtaagcttgccacttttgttcaactacgcgatgatcgtaagtcatatcaaacactcctttttttaacgtgctttcaaaagcatggacacttttgacgcactcttttttaattcacttaacgccaataaaaaagtcctatggtataaataccataggacgaattgaccgcgatgccacctaagttctgtccaatctatattggacaaccctctggccttaacgcggcagacgtttctatctactatcagttcaatagaaaactcaaaggtgagttcgttatgttaaacgacgtgttcacactaaccacacgctctctgaacgcttaacgataactactaatccttctcaacgttaaataattgttcttagcataccaaactcttacttcaatttcaagacttggccgactaagattaaatcagaatgtaaattgttcgctgattttaattgtgcgatactggtattatttttttgtgcgattgaccaaagactatcgcctgatttaaccgtataaatcttcccagaattcgtgttaggcgtcgttggcgttgtagcgccagccgttaattttaagacttgacctgggtagataaagttattcttaatattattagccttgattaattgcgccatcgaaatgccattacggttagcaattccccagacagaatcgccggccttaaccgtataagtcttcccagaagtttgccctggatttgtactgtttgtattattattgtttgaattaccagttgttgcacctcggctaaccactaatttttgaccaggatagataaagttgttccggatattattccatttaaccaagtcagccattgagatgccgtaacggtttgaaattgcccagacagaatcccctgatttaaccatataagttttatttgaggtctgattaccgttattgctgtttgaattattgttatttgtattgccagttgcggtttttgaaactgttagaacatcgccagggtgaatcatattattcttgatgttattccaactaattaaatcgttcattgaaatcccatatttgttggcaatcgcccaaacagagtcgccggctttaacggtatacttatcaccattagctggtgttgttggattcgttggtgttgtagggtctgttgggtttgtcgtcccaccattgttgttgccagctgcactacttgaaacaatcaagacttggcctgggtgaatcatattgttcttgatgttattccagctaatcaagtcattcattgaaatcccataccgattagcaatcccccaaacagaatcgccggctttaacggtgtattttgtcccattttcaggtgtcgttggcgtggttggagtcgttgttcccccattattgttaccagtattggtccctggcgtgtcatattgcgttaaattgtattgttgaatcaaacggttcaaacttgacgcataattggttgctgttgcataacgtccttgtaagtattgtgtggcttgttgatagctacttgtatggctcttaaatgccccttgataataaggcgttgcaccaaatgaagtattccgtagcacatgcacataatcttgtaacgattggtagtatgaaggatattttctaaatgcagcttggatctgatacatgttcccatgaccatcatcttcccaagtccacatataaacagaactaccattgtaagtcccttttaccccaaacaagttataattaggggcagaacctaaaccactgctcccaaatcctgattctaatgatgcttgggcaatcataacagaggcgtacaaatcgttatcacccgctaattgttgagctgaactagcaattgaattgatgaaattttgtgcgcttgaattagctgctgccataacaacgccagcggttgcgatattggcactcgtactttgcactccagaaattggttgcgcttgagatggtgccggttgtggcgtagccacctttgtcgcttcattttcagtcaattgaggttttacaacaggttgttgtgttgattgggattcagttgtcgttgtgcttgaactagttgttgatgatgttgcactacttgctgtattagctgttgtagcttggtcatcattgtttgcactatttaacacatcttcagtggctgctttggcccgattcgaaaaactaggtgcaattgctgaacccatcaagacggttgcccctgcaaaagtcgtcacattacgaactttcttaattctaatttcccgcttctgcttatgtaagcttaccttttgagctgcaattcgctgttttctagtctctttcaattctaacgcctccgaatttccattattattgtctgtggcacaattaacttgagcttcacctgagctttattataatattaataaaggaggaaaacaatcctatcacgcaactacttttattagttgtcttatgcttaataattattgtatcatttaataatcttctttgtctttaattacagcttattttgaaaggatttcttaaaaatgaccaaacgattttcggctagtttattcattcttggcacaatcagttttctaatcattttaatcagcgttgtgcaccatgctacttgggttatacattttgatacccttatcagaactggcatccggtcgctttcctccccattgatggatactgtaagcattgcgattacgtcgatcggcaatccctatagtataatgactttgaccaccattgtaacgcttggtttgctgggctttaaacagtggtcagcagctagctttttagtcattaacatggtccttttttcaacgcttaaccactttattaagatgagcgtccaacgaccacggcccccatttcaccatcttgtctacgcaggcggctacagcttccctagcggtcatgcttcgggggcgcttctttttttcggaactttaagcatcctagtttactacttaattcgtcaacgcgtttggcgaaaaatagcgattggcacctgtttaatattggcactatgcatcggccttagtcggatttacgtacttgttcattatccgagtgatgtcttagctggctttttattagcaacggcgtgtctcggcggttcatggtactgttttattcattttaaattattgcatctgaaggagtcctaacacatgatacttgatcatcccactaaatttgcacattttctattagaccaggcaattcggcccggcgatgtcgtaattgatgccaccgtggggcatggcgatgataccttatttttagcagaacgcgttgctgattttggtcaggtttacggtttcgaaattcaaaaagaagccatcgaaacctgcgcggatcgtcttacaaaagcaaaccaagcgaaccaggttactttgcttaatcaaggacacgagcggattatcactgccttaccacccgagttaaaagtgcaagccgctatttttagcttaggtgcactcagtcctgattcttttgaacacgtgacactgcctaacacgacaatctctgcctatcatcaaattctctcacggcttagtcgcggtggcttactggtattcgttgttgatcctcggttcaatgaaactcaagaagaaatcaactatctaatcgccgacttaagtcgcctagaaccaaccaattaccaagtaacccactacaaggcaatcaacgccgaccaaggacaagtcctagcgatagaaaaaatttagagtgtgatcccagtcgggtatctcttgaggattagcctagactggcgaatgattgctgaaagcaatcgtttgacaatcgtcgctaaccggaaagagatgactgggtgaacacgtttagagtgcgtcgtaaggcgaatatccgctgaggattaacacagcgtcgtgaatgattacaacgtaatcgtttgcggctcaggattaaccggaggcgaatgacttacagagcacgtttagagtgtgtcgtcagtcgagtatctcctattcaaacattaaaaaaaggcccagtcatcaatgatgactgggccttttactatcttataatgtcccgaccacttttgtaccgtgtgcttcggaaatttgtaaacgttctgttaacgcgtcgacattatcggctgtaatgccaccgccaggtaagatcacaatccgcccatcagcagcttgaattaacgtttttaaacgggcttcatcgatgggcgcgtctaacggccccccatgcgttaaaatccgtttaacatcatgatcaatcagccattccattgctgcagcttgttgatcagccgcaatttcatcgaaagccatatggaaaacaacttgcatcccattggcagcaccaatcaacatttccatcgcttcttcgtcgatttgattgtcaggtgttaggcaaccaaggacgatgccgtcagcgcctaattcttgcgctgaaaagatatcagcttccataatttttaattcttgatcgttataaacaaagttgccgccacgcggacgaatcatgaccatcactggtacatcgtgttcatgcgcataacgcactgattcagccatcacaccccggctaaccgttgtgcctccgacagccaagttgtcgttcaactcaattcgtttagcaccattgcggattgctgccggaattttagtgaaattttcaacacaaacttctttgattaacatggatgaaccctccaaattttaatttaatcctttatgcaaatagcattgcacctaagacaagtaggcccaagataatccggtaccaaccgaagaccttgaaatcatgtttcttgatgtaatccatcaagaatttgattgaaataattgaaacgatgaatgaaaccaacatcccgactaataaaatgattgattgatcgcccgtaaacgtattgccttggtacaagaatttaccaatcttcaagattgccacgccgaccatcgttggaatcgccatgaagaacgagaattccgcacccacaaaccgtgatgtccctaaaataattgcccctaaaatcgtagcgcctgaacgggatgtcccaggaataattgataaggcttggaaacagccaatccaaaaggccgtcaaccaaggtaacgtatttaaatcagcaaatttcggtgtggtatgcttgttgcgattttcgatgacgatgaacaaaaccccgtataaaatcaacatgctggccacaatccagtttttcatcagatgttcatccatccagtcattcaatgggaatccaataatgactgatggaatcaccgccacaattaccttaaaccataacgtccacgtttgtttttgttcgagctggttcttacgtggtgagaaaggattcaatttatggaagtatagaatcacaaccgccataatcgctccaaattgaatcacataattaaacatatcgatgaatgcttttgattcatcaagtttcaaaacactaccgaccaacactaaatggccggttgaactaattggtagccattctgtaaaaccttcgacaatccctaaaatgattgtcttaatcatatttaaagttaacacaatactaatccctccgtaatccataatcgtttattagtatactcattctaaagttagattgcgactcaaattgaaagcttaatcaaattttattcaattcgcccgcaggaaaagccaaatgacgttgatccatcactgcttgaaaatcggctggtagttcgctttgaaccgtgacataccgttctccaaatggatgatagaacgttaactcgcgacagtgcaatgcttgacgcggtaataaatcatcggccacaccgtataaattatcaccaattaagggatgccccagtgatgcaaaatgaacccgaatctgatgtgtccgacctgttagtaacttcaacttaactaacgtggcatcggtgccatgggcttcttgccaatattccgttaatgagcgtttgccaccaaccccaacgacccgccgcatgtaaaaatcatccgaccgtttgattggccgatcaatccacgcatgttgcggataatctaaccgcatatcaccactggcaatcgcaacatatgttttttgcaattctttagattggagttgcttatccaacaaactatgcgcgaagccgtgcttggtgaacatcatcaaaccacttgtatcgcgatcgaggcgcgttactacgtgcactgcctggctctcagcattttggtcaatcaagtattgtttgacgaaattggccattgtgttgtgcggatggttcggtgccggtaacgacgccacaaacgccggtttatcgaccactaaaaaatggtcgtcttcaaaaaccactttcaagtcccctttaactgggatgacgtgttcgacggccacttccggtgcgaggtaaacagtcaccacatcgttttgaaccagttgggcattggtatgtgcctcctggccgttgacgaggattgtgccacctgcaaatttaattttagttaactgactgcgagaaagcttatgccgccgtaaaaaattccgcaacacacagccttctgcatcttgatattgccattcaaatttcatgttttgacccaataaatgcatcttcgacacggttccagaaatgggtgtgtcgataacgtgcaaactgtattctttcctttgcaattttaaattgcatcgaggcaattggtcgatccttaaatgtgaattgatcaattgtcacaacgtaatcacttgtcttagaaggcttcaggagcaaccattcatccgatggtaacacgattggtgccgatagtgttcgatatacgcgattattaatcgacgcaatttcggtcatctgcatcgcgtctaagcgtggatgtaaaaccgcgccaccaatcgacttactataagctgtcgacccagttggtgtggaaatacagagcccatcgcccctaaaactttcaaaaaaattctctttaatgtaaacgtccgtccgcaaagtcgctgcataccgacgtaacgtcacttcattgagcgccaaactgcgactgatttcgtgcgtatccgcatattcgattttaacttctaataacggatagctaatactctgcccgagatcttcttgcaaggcgacgactagatcatcgacttcaaaatcgcgccagtcagtgtaaaaccctaaatgtcccgtgtgcacgccaataaaccggatgtgcgctaaatcgtgggcgtaccgatgaaaggcagataaaagcgtcccatctccaccaactgaaatgaccacatcgggcgtttgatcatcaatgacaaaccccgtattgatcaatttttgcgttaagcgattggcaacttgaacggaagaactaccgtcattgctaaataccgttactttcaatctggcgtctctccttcagaatcattttcagttgccttttcaagtgcgttttgccattttccatatgagaagagttgttgtgcttcttgaatttcttcacgaatttcagacatttctttatctaacataaaggatgcttcggccgctcttttaagccgcgccttcagcgtttcaggaaattccccttgatatttataatttaatgaatgttcaatggttgcccaaaagttcatcgacattgttcgaatctgaatctcggccaaaatcaatttttcaccactgattagttggactggatattcaattacaatatgatatgaccggtaaccacttggtttaacatttgaaacgtaatcccgttcttcaacaattttcatatcagtccgttggtgcaaaaggcccacaatttcatggatatcttccacaaactgacacataatccgcaaaccagcgatatcttgcatatcttgttcgagtaaatcttctgtaatgtagcggcgttgcatcttttctttgatactatcgattggtttaacgcgcccagttacaaattcgatgggtgcatgttcattattttgttggtattgcttgcgcatcccacgtaatttaatttttaattcgctaacggcctgttcataaggcattaaaaacttcttccaattttcgaccattataaacccctcattcactctgtcacatacagcactattttaacatagattagaattgaataaataataatcgtctgaaatacaaatttcattacaagtctgcttttttgtgctaggataataacattgcttttttaaaaaggagctcaaccgatgtcacaaacgattgaacgcgaatttaagacgatgctaacggcggcgcaattctcgcaactaaaagcggactatccatttgcagcgccgtttgtgcaaaccaattattacttcgaactgcctaaccagggattggctaaacgtcactgggggttgcgtattcgactctttgacacctatgccgaacagacgctaaaggtgccaaccgtagaaaatgctcatagtctgattgaaatcactgatcgcctaacacttgagcaggctactcacttaattgagcaccaaaccgtattatcgtctggtcagatcgctgtctattttgcagcacaagccgtgattatcaaagaattgttcatctggggacaggcaacaacgcaccgccagaccgcgtctttagttgctggcctgttaacgcttgatgttacccaataccctgacgaaacccaggattatgaagtcgaaattgaagtcaccaacgtccaagaaggggcaacttggtttaaatcatttgtcacccgctatcaattaagtgaacaaataccacccaataaaattatgcgcgcccttatccatcaagcttaaactttgtcaagctaacttattgcataattttaaaattttgttagagtagacagtacaagcgcgtcgagcagtatatacaatatagaaagtttggaggaaccaacttgttagaagtgtttttatttatcaacccaatcgggcaactttgtttacgttccgaagaggcacttttaaagattatcggcgaaaccgatgcaaatattcattttaagtttattccagtcttaaacttaaaaaacgtcgagcattacatgcagtttcagcaacaaaatagtcatgatttaaacttacgtaatcacgttttcagcaccatttatgaagcagtactcgcttataaggcagcaacgttccaggggggcaagaagagccaatcatttttaatgcaactgcaacaagcattccgtgaaccagatatggaacttaacaacgaattagtccttacaattgctaaacgcgtaggacttgataccgaaatgttacttgaagattggcacagtccacttactaaacaggcatttgattcagatcaacaattatcttgtgagatgaacattcagatgaccccttcagcagtagtcttcaactattcaaaaggtgaaagcgaatcaggcttattgattgaaaattgcgattcctatgaactcttgaaacaagcctgttgtgctgaaacaacacctgaacagactttccaagcacttcaaaaacaaaaaagcaccctctcacgggttgctttgcatgttatttcttaatcttagaaccggtggtcaaccgacccccggttcttttttaatgtttgtttcaaagctatttgcccccattgtgcaaataaggattgctttagtagtggttgttggagtaagggcgttaccgctaaaaaaagatcaattggttgggcactcaaccaccacgttacccgactttcaaactgactgagctgataaatgggtggtacattacgtgtgcagtaacaccagtccggaacggcttgcaagcgttcatggtgggcataacaatccgcctgtaacgcaacataatgtgcgtcttgcagccctaatcgacggtcaataatttgttgctgcataggctgtgacttgcccttataatgattggctggcagtcttgtttgtgctacaagcaagcgcacaaacgccttagttgtcaatcgcagggtttgccaagcataaccagcaaaatcacgggcgacaatatggtgatataacacccattgcccccactttggcaaataacttaccacataaaagccccactgccgccgatagttgataaaccccaactgttgctggcttaaataatggttagtaaaacaataccgttcaccaaccacccataatacaggtaatcggcgctgctgatagccgattgttcgttggtttaacttatctggcgtcaatgggctgcattggtattcaataattaatggttgttgattccgcgttaaccatacatcagcgcgctgtgtctcgccgacaggtacttcaaaggtagcatgccagcccaacgcatgtgctaattcagcaatcgcctgttttcccgccagatgggctggactctcaccaccaccagatacacgttctgcgatatgtgcgaaatatggtgctttatgcaccccacgatgcaactgaaccagttgttgacaatgtggacagaaataccgcgctacttgctgttgtttggctgcttgatcggcgcgaattaagcacccgttagtggtctgtgcaactttcattatttatcacccccaccgaaaatacgcaaaaaaataacgggttctcctaaatttaggaaaacccgttatttctaatgtttgaagtagtagcgtgttaactcaagcgcactattatccatgactttttcaccgaattcacttaaaaaagctgctgtgtattctgacttctgcccgtattcattagcgaccgctaaatcatcccgtgcaaacgcttcggtcgtattctccataaaaataataatctgtgcatagtactgatgtttgtaaagaaataggttcgacacaccactttcgatgtgtagctgttgtgccaaagcaatccaatcgtcaaatgacttaaacgataacacaatctgtttcattggattgtccgcttgattcatataggcggtcatttcatcctcttcctcagtcgcatcatcttggaccgtatctcgtttcaacagttgttctttaatgtattcagtaataccgtctttgccttgcaccatttctgattgacctttaccaccgtcaaagtttggcatattcttactaatcagtaattctaacccttgatcgttaggcaacacttggaacgttactgcatcgttgttcgcaaatgtgtgttcactgtccacttcttccagaattgaatagaagaaccgctcaatctttttatgattgctcaacaaatcaagtccagtaatcccgcgttcttctaaatcatcattttctaatagaacccgaattgtgttctcgtcgattttttccattctcatgggacaacgcccctttctaacgcgcttcttatagcgtcgtaattcactttctttgacctaccataccagtatctggcgtaacattcaagtatctacatcgcagcaattaattttttaacccatcaaaaaagtcgaggctgttaacagccccgactctcctctagaatcctgctagtaattgtgcttgttgtaattccaatgcccgtacttcacgtggtaagaaacgacgaatttcatcttcgttataaccaacctgaagtcgtttttcatccaaaataattggacgacgtaatagccctgggttcttttgaactaaatctaataattcgttgattgataagtcatcaattttaatgtttaattcttggaaaaccttagaacgcgttgagataatttcttccgtgccatcttcggtcatgcgtaagattgttttaatttcatttttattgagaggctccgaaaagatattgcgttcttggtatggaatattgtgttcctctaaccacgcccgggctttacgacaagatgtacaacttggtgatgtatataacgtaaccatatgtctctctcctttattaacatgacaccttacttaacaataagacaatcattttctctcttacaaattttattatacgcgagtcagcactagaaaactaccctaaaattaaatttattaattattttttaataattaataaatagacatttggacataaaacgtctaattaaaacggtttattgttaaattttcccactcaccattaatttttatgtttttacatttatatttatcattcaaaaaaaattatagtagtttctactttctaatgaaaattcacttattttttgtaagtttcatcaacgccgcctatattacacgctccgacatcaattgtcaaatcctgttgggcaactatcacgggtacgtccccaacagtcgcttgtgcttgtgcctgtagcgtttctgccgaaaccccttgtggtaaatgcgttaatagaattttagctgcgccactttcttgtgccaagttaccggattgcgttgttgtcatatgcgccattttaccagtgcgatcttcaagaaaattcgtatcagtcatcagtaaatctgcagactgacaaaaagcagctaattctgggaaatacgccgtatctgcagtaaagaccaagacctgccccgtcgtttgttcttcaattcgaacagcgaatgctgggacaggatgcactgtccgtttgaaagttactttcaacggccccagggtcagctctgtgtcttcttgataaccaaagccctgcgtcacacccggttgtgtcaaactgccaaagtggagtggatcttgcagatgcccgtaaataggtaaaatgggttcctttttggttccttgatgcagttgccaataatattgtaaaacccccacatcagcaatgtgatcgtgatgatagtgcgtgagaaggaccacatctagttgcaatgggtcaaattgtttctcaagcgctaataaagcgccactcccacaatctagcaataaatgatacgccccacttgttaataaataactactagtcccaacaccggcgtatggatatccaccgtaataacctaagactgttaattgcatttttaaatgaccacctttctaatttctatagtagcgcattccgggtatcgcgcgcactatatttactaactaaataaaaaaagaccgccacccaaatggatgacggccctaatgctattgaatgacttggactttcttagctttaacttcttgatagaaaatcgtaacgctcataattaagtatggatagaaccacaagagacctagtccagcagtcatatagacgaccagttcccatccaataaatgataaagtaagcccgagtaatttcagccagttcccttttaaaatcacccatgaaaggctaaagattaatttgagtggtgcttgtggtaaatcaaacttcaacagtactaaaatctgataatacgttaaaatcacgggttgcaacagtgacaaaaccaacatcaccgtcacaaacaataagacagtttcagaaattgtcccctgctggctaatgtttagcaaataaggcgcaacggaatctaatccattaaaagtgaattgaaatacacgatcccaaccgagtaaccgataaaacggcgccaacccaattaatagtaagatccagtttaacacttgttgaacaagattcaataccacaagatgggtatacaacggttgccggaataacaataaggtatcccggtaatagctgggcttattctggctaactttataaacacctaagaaaacagcatttaaaaagataaagtataagaaataattggcaaaggtgttgagcatttgataaccaaatgaactggcgccaaacacgccttcaatcattgagtcgactactatctcaactaacaaccaaagcgcgactaaagcggccattttctgccagtttccttttaataattgacgcgcttttgcgcggtacatagctaattgcaaaaactttccctccgagtttagtagaacacatcactattgagcggtgcattcacaattcgattgtagatattggccgtaattagatagaaaacaaagtaaatgatgataaacaggccgcaaacgatataggctaattgtaacccaggattatctaaaaacaaacccaataaccgaattgcaaagaaggcgtgcatcgatcccaaaataattggcagtaaaaagagcatcaaaatttggaaataaatcgtgcgcttaatctcaccgtcactcatcccaatttttttcaatgttttatactgcaaaatctcttcttgtgcttctgacaattgtttcaacatgatgatactaccagtggctaacatgaagattaacgcaataaaaatggcgacatacatataaaatccgaagtttgcgttagcaatatctcggttaggttttttcaaaagcacagaatagcggcttaactcttctagccgttgatcagtggttttaatttcataatgggtttgcccggcttttttgtgcgtcattaaataatcccattgtttgggcttttgagatagacggaataaatcgcgcattaatcgtttttgcttttgttgggcagcggagagctgaactgcatagatttgatcaactgaagttgcttggacttgttgatattcagcatcattggccacaatcacgtttaagttaccatcaaagaagacatcagaaccgtttggaaatagcttacgaatgtgtacaatccgaaaatctgaaagcccagactgttttaattgcaacgggattccagctcttttcggtggcaaacctgcacctgctctgcgaggcatcttcagcattgttaatggcaagttaatgatggtcaccacagtatttttcttcaatttagttgctggtaacttaaattgttgcgccattacttggttgtattgggataatggcatgacaacagctgctccatccattttgatgccttcccgatttaacggtgaattgaccttaaatcgagcatccaccaatttaaacgaagacattgtttgactaaccggctgaacatgatattgcgttaaaattttgtcgaccgctgctttttgactttgtgtataaaccaaatccaccggaatgttctgccgtaatgtatcttgaccgtgcgtataaatcatcgccgcacttccgattgcggtaatagtgactgcacttaaaatcgtaatcatccacaacatctttgcattctttttaaaacgaaaactcaaattcgtaacgtttaacaaatgtgtcccacgataataaagccgtttccagtgccgttctaactgtagccaaatttgcgtataggcctgaaaaaaagccagtgtgccaaaaatttcaagtaataaaatggttagtaaataaaccaaatcaatcccaaaaccatagcgccgctctaagctcggcatcaaaaccagtgtttggtctgccaaataatagccgctgataatcaatacaggtgcaataaccccccataaataagtcagccagttcggtcggcgcactttccgactgactgcagatggttgcagcaatgtcactaattgataccgataaatcatcgtactgtttaaaaaaccagttaataggaacaacccgccaaaggtgaatgtcgtttgttcaatggcccgccatgatattaaaaacggcatggcaaccgcaatccccatcatgcgtaataataacatcgcgaataatttcgaaaaaagaatcccgaataacaacccgataatcagggcaatcacacagataatcaaactttcaaagaagaagagtaagctaatctgaaatttagtcaccccgatgacacttaaaacaccaatctcccgccgacgccttttaatgaaaaataaattagcatatgccaagaaaaaagcggcaaacagcaaaataattaaacctgctacttggatcatccggccaaaagctaaagattcaccagccatcttgaggtgcctaaagattggcgcagtttgaatcgacgtaaagcagaaataaaccacaatcgcggcaacacaggcaatcacataagccgcatagtcgcgcgcatgattaatcgcatttctaacggttaggtgtaacagcattgaaacggcctcctccacctatggttgcttgcatatcaataatttgattgaagaattgttgccgatcaccattgcgaacgatttccgagaataattgaccatctttaatgaaaagaattcgccgacagtaactagctgtaaaggcatcatgcgtgaccaataaaattgtcgtcttttcctgacgattaatcacggttaaatattgtaaaagctccgtagctgattttgaatctaaacttccagttggttcgtcggccaataacaaagtgggattggtaatcattgcgcgcccacatgccactcgttggcgctgtccaattgaaacttcatccggataacgatccaacaaactactaatgcccaagactcggctaactttatccaaccgtttttcaatcactggcacacttaacttatcaagcgctaatggcagtaacatgttttcgcgaaccgtcagtgaatctagtaagttaaaatcttgaaaaataaagcccaaatcttgccgcctaaaattagcaagcttagcttcccgcatccgactcacaacttgatctttaattaacacttgaccatgcgtcggccgatcaatggtcgcaatcatatttaataaggtcgttttcccagcgcctgaagggcccataataccgacaaactcccacggttcaatatcaaatgaaatattattaagcgcattgaccagactaaaccgatgcccgtagactttcgaaacttgttggactgatacgactgccattttttcacatcccttaactaattggtattcattttagcagagttgaccgcaaaagcccattttataactacgaccttagttggttgtcttttctagtgaaagtggttaatattagtctatctatgtatgaggagaattcattatgtttgaaattatgattgttgaagacgatccaacgattgccaacttaatcgctgagaacttaaataagtggcaattacacgcaaatattacgaccgatttcgataccattttcgaccaatttttaaccaataaaccccatctgattttactcgatatcaacctgcccgtttatgacgggttctactggtgtcgcaaaattcgtgaagtatctaaagtccccataattttcatttctagtcgcagtaccaacatggacatggtgatgtcgatgaacatgggcggcgatgacttcgtcaataaacctttttcgatggaagttttaattgccaaaattaacgccctcttacgacggacttacaactacgtcgaccaaaatgccgatatcatcgaacataacggcctaatgattaacctccaaagcggcggagctcaggtgggtgagactaccattgatctttccaaaaacgagtataagctcctccaatttctgatgcgtcaacacggccagattgtcagtcgcgaaaagttattgcgtgccctctgggacgatgaacggtttgtcgacgacaacacactaaccgttaacatcaatcggcttcgcaaaaaaattgaaagtgctggtttagaagactacattcagacgaaaattggccaaggctatatcatcccctaaggagttattatgacgtttaaaaaattcttacgtgatcatttatttcatatcgcttttttcttcagcggtatgattgttctggatatcgtcctatggctcgaccctagtatgcgctttgctaaggcgacacttttatacctcgatttattgctggcgctttttttctgcgcctttttggttggcttatacgtctaccatctcaagtggtaccgcacaatccaaacacgcttagatgctaaagaagatagcctcaactggccacttacaggcgctacctcggctgaaaaacaattcattcaacactacgtgaatcaactgctagcctatcatcaacaaagcatcgaccgactaatctcagcgcaacaagatcaaaagaatttcattgatggctgggtgcacgaaagcaaggtccccctggcagctactcaattgctcattgaatccatcgaagaccagattccagaagacaaattcaatcaattaaccgatgaactgattcaaattgaacactacgttgaacaagtgctctactactcgcgtctcgatagtttttctaaggattacttggtgcaggaatacgatttaaaacctttagtcaaccaaatcatccgccaaaatcgcaattattttattcaaaaacacatccaatttaaactgcttggtgccgatcaaaccgtcttaaccgacgctaaatggctggcttttattttgaatcaaatcatttccaatgcgttaaagtatacccccgacggcgcacaaattacggtacagattgaacgtgacgaacaaggcgtttggttaagtgtcatcgatacagggattgggattccggctgaagacctaccccggatttttgataaagggttcaccggtcaaaatgggcgctattctaaccaacgttcaaccggtttagggctctaccttgcacgtgtcttaagtgaaaagctcggtcacgaactcaccgttagctcccaacaaggcagtggttccacttttaaattactctttccttttttaagttactacaacacggatgacgatgacggcttattcggcaaaacccatcctgcagacaaatgaagcggagcttcaaaatgcgtaaaacacttttaatcactacacttttaacaataacactcctagcaggttgccaagctaaaaaaccggtttcatcaaccacatcccgcgcgcagtcaactacgacgacctacgccaaccggaaaacaactaaaaaagccctcgcgaccgattcacagacttggttgtttaacaaacaactcctttctaagcaaactaaaaacggtctttctgatgacatcaccgttttaaatattgctcaaatgaccactcctaaaagttggctgacctctaaaggcaccttcacaagtcagccgattaattatcaacaaatttcgtttaaaaaatggcaacaagatagccgcagtcatctgatgaagagctatcaaaagacactccatctgatgactgtggcacaagtcaacgctgcattacacaaattgggggctgactttaagattaaacacctctcagatctcgtctttcttgagactaagactgggaaaaatacaattgaccaaggattcgttgccaaaggaaatcatctatacgcaattacagctcattacagagatctacaagaacccaccaattttgaccgcggacagttattcgtcagtcaaaaagcaaccgccaaaacaaccgccagtcctgttgccctcgaccaactcaatggcacttggattgcggccgcaacaacgacgagtgctaatgacaccggaaaactgatggtcaaagatggcttcatgtaccaaaaatgttatgatagtattgaacgctctgccattcaagatcttgccaaatacactttagtaacgctcaatcaaaacacaatctatgctgctcaaaaaagggatgcagcacaagctggttatcaattaacccctaagtcgattgctagtggtgatagtatcggttatctctacctcttcatgaatgatcatgaactgctacgcatcggtgctggtcaagcaacaagctatcaaaagacggattcactagtagctgctgccgatttatcacagactgatcaaaccatttttgagcaacttgatcaacaaaagcctggtgaatcagcttcaaccattacggtcaaagcaggtcccgctgttgtcgggatgagtgatagtgtcaactatctaaccgatgcaaccgctggccagatttcgaacaatatcgtcattggtaacgttcaaaacgggcacgtcaccattgcaagtgagtcaactcattaattataggcacaaaaaaaaggtccgacattcatgtcggacctttttttgtgcttaagccgcttgatcgcgggctgcttcttcttttaaagccatgtctgtggcgatcttgatgaatggtaggtaaatgagcactgaaacaagtaagttcactgctgctaataccccaccttgccaactaaccgttgcgatgaccccaccgataattggtgatgttacccaaggtggcataaccgttgcagcgggcactaacccggtgctagttgcaaagtatgcaattgtaacgatcaccattggtgtggcaatatatgggatgaataaaattgggttcaatacgattgcaagccaaatgttaatggttcgttaatattgaagatcccaggagcggcactcaaattcccaacgattgaatattgtttattctttcgacccactaaccagattgcaatgattaagcctaaagtagcaccagtcccacctaagttaacagatgaatcaaagaatggtttgttaacaatatatggtgctgctttaccagctttaatcgcatttaagttagctgtaattgcaggtggtaccccatcaggcatcttaatgactaagtgtttattacccaataaacgtctgagaatttctgttgaaatcatcgcaacgattaaagcaacgaacaagcccattgagtccatccctgcaagaccgccagcagcaaagaatgaccctaatgctgttacgccgactgctagtggattgatattatatgacttacctaaattgtaagcaactaggaagacgataaacacagaaagaatcgcaaatatcccgctccaagcattgcccccgaatttagtccagatataagccttttcagcgcccttaccaactgtctttgagaacacactatccatgaaattggtatatgccggaattggtaaattattaatcaaggttgcaaaagcccccaagatcatcaatggcatcgttgttacgaaggcgtcacgaatggcaaatgtcgttgattcccaacttttgccacaactggtaaaaagcgtttctccatgaaactgataaatgaatccattaacctcactccttttcctgaatcataattaaaaaataattgctattacaagtattatgttacagaaagcgttgtcaaacgataaccccgttcattacctatgaatgtccagtttttcacaaaaactaaaaaaagcgccaccccattctaatcatggattgacgctcttttttatccgtgttaggtatataccaatgacggaaaatgaaaattaaatttttaataactttattttacatattactttcaatgaacaagctttgcccatataacgggctttttagcggctaatgattttttgacatcgataatccgttgattggcactccctctgaactgcaatgtcagatccatttggtccttcatgaagcgcccatcaactaagatatcaatcttagacagcaactcgagtttatcatctgattcttgcatcagttcttcccacgtatatcccgtccatgaccagacgtcctttgtctgcccataagtggcgcgaattcggtctactagcgataaacaagtcttggtattcaagaacggttcgccacctaataacgtcagtccttggacataagattgccctaaatcagcaataatttggtcttctaattcagttgtataagggcggccatagcgaaaattctgcgccactcgattgtaacaaccggggcaagcaaacatgcaaccactcacatataggctacagcgcaccccttcgccatcaacaaagttaaacggtttataatctgcaatataatcctggcttagtgtttcagaaagccattctttgggcgccggattcttcgggccttgttgttttactgccatcttcaaaaactccttcaaatcccgtattcacaattactgccgtgcaacgttgttattatcgttgccaatggtaatatgcatgtgcttaactcgactggcgatttccttatgccgaccatgcaccattggacgttgttgtggattacctagataaccacaagtccgcttaacgacgtcacatgtagcagcatccgtgttcccacattgcgggcattggaacccgcgttctgtcggcttaaagtcccctttaaacccacatttgaagcattgatcaattggcgtattcgtgcctaagtagccgacacgatcgtaagcataatcccagacagcttctaaagcctttggattttgacgcagatttgggtattcacagtaatgaatgaacccaccagaacagtattttggataatctttttcaaaatctaatttttcaaatggggttggtgctttacgcacatcgtagtggaaactatttgtgtagtattctttgtctgtaatattttcgacaatcccaaatttttgcgtatctttttgacagaacgtatttgttaaactttctgctggtgtgctgtaaacagagaagtgatagccgtattccttttcccaatcaacgcagtgattatagaggtctttaacgacgtctaccgtaaaggcttttgccttggcatccttttcccagtctggcccaaagaaggctgtaccgacttcataaaggccaatatagcccaatgaaacagttgcgcgtgaatttttaaagacttcatcaacactatcggttttcttcaaacgcttgccaaaggcaccatattcataaagaatcggcgcattttctggcttcgcttctttagcgcgttccactttaaagaccagggcttccttgcagacttgcaaccgttgttctagaatttcccagaacttagcttggttgccatcagcttcaagtgcaatccgtggtaaattgattgtcaccacgccgagattcatccggccactattcacttcttcaccatgttcgtttttccagccttgtaagaagcttcgacaacccattggtgctttgaaagaacccgttaattccaccaacttgtcatacattaaaacatcgggatacatccgttttgtggcacattcaacagctaattgtttgatgtcataatttggatcagttggatttaagtttaagccgcgttttactgcaaaaactaatttagggaagatggcagtccgtttttctttacctaatccttcaattcgaattgaaagaattgctttttgaatcgcacgttcaatccagttactgcctaatccaaaaccaagcgttgtaaatggtgtttggccttgggatgaatataaagtattgatttcatattccaacgcttgcatggcgtcataaatatctttttcagtcttggtttgcgcataatccttttgttttgcttcgccatcaatccaattcttggcatctgctaaatgtttggcataattcttttcggcaaatggtgccaataattcatccacccgatcagcggaacaaccaccatattgactagaagcaacgttagcaataatttgtgacatttgtgccgtagcagtttgaatcgaatgtggcgcttcaacttcggcattcccaatcttaaagccatgattcaacatttctttaaaatcgattaaacaacaattggtcattggactatatggttggtaatccaaatcgtgccaatgaatctcgccttttaaatgggcgttcgccactttatcaggcaacatcttaagccccatcgctttagcaactgtccctgccgttaggtcccgctgtgtattaaaaacatgactatctttattcgcattttcattgaccacagtttggtcttttttcaataatttttgaatggtaaagttgatatcagttgccttattccgggcaaagtcccgttgcgtccggtagttaatgtattcttgggcaatatcatattggtgatgttctaaaagtttatgttccacaatattttgcagttcatagattttaacatctttatcaaatcggctgccgacttcactcacaacatctagtgcgactgtgtttaacacttgatagtctaatggctctaattccgtcttcacatttttagcggctttaataattgcttgttcgattttatccgcagaaaaaggcatgattcgcccatctcttttaatcactttaatttgcaagtctgcttctgaagcaattttcatatccatcttagcaccagtctccttttgaatcagtaaccccatcatagcggattaaaaattcagattcaacctatatatagtagataaaccaacaaaaagacgcactgcaactatatgttgtgtacgtctaattgtgtgcgatattttctttcgcccgtccttatcgaaatctacttcatactgcttaaaaaaagattgacatcatgcatctcgttttaatttcaaagtcattgcattaatagccacaacaattgttgagagtgacattaagattgcaccaactgctggacttaatactaacccaattccggcaaatagccccccagctaatggaatcgctaaaatattatacccagcgccccaccagagattttgcgtcattttgcggttagttgcgtgcgataaattcaagaaatgcataatatcgtttggattactcttcacgaggatcacatctgctgaatcgattgcaacatccgtcccagcaccaattgcgattccgatatcagcccgcgttaaacctggtgcatcattaacaccatccccaaccatcaggacgacttcgcctttagcttggtaatctttgacgattgcttctttatcttctggtttcaagttcgcttgaaccgtcataccgcccaattgtgcagccactttttcggcaacttgttgattatcaccggttaacatgaccggttggatatgccgtttctttaatgcttggatgaaagctggcgcttctggtttaatctgatcaccttgtgcgactagtcctaaaaccgtttgatcttgtaatagataactgatggaattccctttttctgctaaagtttggaaaagagcttgatcaaatttaatatgctgggcttgtaaataagttgccgtcactatttgataactttgccctgcaaccgttccagacaaaccgacgccttgaatcgtttgaacattgtctgcctgtaaatcaggaatagtttgtgcttggttatactctagaatcccagtggccaatggatgacttgaatggcgttctaacgcaccaaagagttgcatgagtcgttgttcatcaagtgctgtatcgaaaacttcgacagcattcactttgaatgcgccttgtgtcaaagtccccgtcttatccatcaaaacaacggtaaccttatctgacaattcgattgcttcacggttacgaatgagcaagccgtttgtagccgcaatcgctgtacttctggcaaccaccaatggaatggccaatccaagtgcatgcggacaagcaataataaagacggttaccatccgttcaaaagccgtattcagatcggccaagaacacccaactaatgaaggcgataatcccagcaaccaatgcagcatagaaaagatacttcgcaactttatctgctaacccttcaacttttgatttttcttgttgtgcttgtttaattaatttcatgacttgcgctaagtaaccactttcgccagtcccggtcacttgcacggttaacgtcccatttccgttgactgtcccaccgattacttgatcgccttcagccttcgcaacagcctttgattcacctgtcactaaggattcattgacttggctttgaccggcgataattaacccatccgcgggtactttttcaccagctgcgactaatacagtttgtccttttttcaagtcctttaaatcaaccgcgtgttgatgccctgcttgatcaattacttgtgcttggccgggtaacaaagcagccattttttctaaagcactccctgcactcattaccgcattcatttcaatccagtgtcccaacaacataataacgattaacgttgcaagctcccagaaaaagtccatcacgtggccttgtgggttcaagaaatggttcgcaacaaaggcgtataaactatatggataagaaacactgatccccattgcaattaaggtcatcatcgctgggctcttagcagataattctccttgagcgccctttaaaaacggtgccccaccgtaaaagaagagaaatgttgctaaaatcaatactagccaatctgaacctgggaaagtcgtttgaaaaggtaactgcatgcccataaatggtgagagaattagaattggtaccgttgcaattaatgaaatccagaatttttgttttagatttcccatgtgcatcatatgaccaccatgcatcatcatatcgccgtcgcccatgtcatggtgcatcccatgcatatcgtgattcatatgccccatatcatgatccatcatctcatggtcatgatgcatgtcgtgcatgctgtgatccatttggtgctcgtgatgcatctctttcatatcgtgtccttcatgttcatggtgcatttcatcgtgtttcattttacttcctcctctatgcaatcacaattggctggtaaacaatcacattcaatcattgttggtgcactaggtaatttagccgctaacaccgtttgtaacgtctgaatatcattttgactgagcgttgtttgctcgattaaagtggctaatgtgcggccttttttcatcccacataattggttaaacagcgactgcgtggcatggttcatcgcttcatcttctgcgatattggccgtatatataaatcggcgtccttctttagtggcaattagatagtctttttttaccaaccgacctagcaaagtcttaacagtcgacgcttgccaatcacgcttttgctgaacgagttcaattaaatgactgctgttgacttgcccaagtgaccaaaccatccgcataatttcccattccgcatccgtaataacccctattttttcagtcattcgcggttttctccctttcgtttatatttgtaatcattagttacagtttacatttgtaatcgataactgtcaatcttttttgctcatccaaattttacgcacaaaaaaagaccgccacagtgggcggtcttttaccatttaattaaagattttgcataaaatcttcaactaatttttggttttcttcattacttgtattcacattaacagcggtttcaactaaatcagttaattgagttgtatctaaacgtttcatcaagctccgaacccgaaggaccgaagttgcgctcattgaaaattcatctaagcccattccaacaaggagtggtgccatgactgaatcgccagcggcttccccacacattccagtccacttaccttctttatgagaagcgtcaataacgttcttaattaaacgtaagattgctggattgtatggttgataaaggtatgatacacgttcattcatccgatcagcagccattgtgtattgaatcaagtcgtttgttccgatactaaagaagtcaacttccttagcgaattgatttgccaagacggcgctggctggaatttcaaccatcatcccaacttgtaaatcatcagaaacagtttgaccatcagcaattaatttagctttttcttcttcaagaatgccttttgcttgacggaattctgtgacagttgcgatcattgggaacatgatacgtaacttaccgtagtttgaagcacggagtaaagcacgcaattgtgttctgaaaatatcatcacgatctaaactaatccgcacagcacggtagcctaagaatggattcatttcttcgggtaatggcaagtaaggtaatttcttatccccaccaatgtccattgtccgcacaacaactggtttaccagccataccttccaaaacagtcttataagcttcgaactgatcatcttcactaggtaattcagatgagtccatgtataagaattctgtccggtataagccgattgcttcagcaccgttatcgataacaccatctaaatctttaggtgtcccgatatttgcagcaactgtgaatgtttttccgtcttttgtaacggatttttcattctttaacttttcccattctgctttttgatcagcgaaagcttgcgccttcttatcgtattcagcaatgtctgcatctgtaggattgataataacatccccgttaatcccgtcgacaattaattgttcgccggctttaacagaagttgtgatattttcagtcccaacaattgcaggaatttctaaagaacgagccataatagcagagtgagaagtccgaccaccaatatcagtcacaaaagccttaacgaatttaccgtttaattgggctgtgtcacttggtgtcaagtcatgagcaatcacaattacttcttcatcaattaacgctgggttagggagtgttacccctaataaatgactgagaactcgcttagtaacatccttgatgtcagcagcgcgttcttgcatgtatgcgttatcagtcatagcctcaaaagtggccacgaataaatccgcgatctctttgagcgcttgctcagcattaaccttgtcatcattgattttaccttcgatagcgccggtaaattctgggtctgctaaaatcatcatgtgggcatcaaaaacttgtgcttcttcttcccctaatgattcagcagcaatcttccgaatggtctctagatcactcgtggaagcttgtaaggcattatgcaaacgattaatctctttttctgaatctgaaatagttgatttcgaaaatgacaaatcgggttgcactaacatataggctttcgccgtagcgataccatcactggcagcaatccctcttagttttgtcattattcagataaaccttcctttttcattgtttcttcaattgcgttgattgcgtctgcttcgtcagcaccttcagctgagatagtaacgtcagcaccttggccaacaccgagtgacataacacccatgattgacttcaagtttacagatttacctttgtattctaagttaacatctgagttaaatttgcttgctgtttgtactaataatgtagctggacgtgcgtggatacctgtgtctgctactacgtgaaaatcgcgtttttccatattaatcgatccccttttatctaattatagatttagtttttaacgaaatgagtggtcactaatagtggctacccttccgatatttaagattaccattttttttaaaatactacaacagtttcgctaacaaaattagtagccgtctacactataccgctttcagacttgcggtagattaccgcaccatttcgttgtgcttcgcccacaatttcttttcgatggtcatagttgacccatactttctgaaaatctaaaaattcggactgagcaacctcaatctcagtttgttcgttatttattaaggcatccatctctgctaaaaaatcacgcatctgccattctgcctcctttgcaattcttttatcgtggcttgaaaaattcgttttcattccatctgcgaaataaaacgatgacctcatactaccgcataccgcccatacctgacaagaaacttttattttcgagttgcctgacttgcaactttttttagagatgattataatttggataaaggtcaaagatagtcaagaacactttgacgattctattattaatgaaaggttgtgacagattaatgctttgtcaaaactgccagaagaatcctgcaacgattcatctctatacaagcaccaatggtcaacgacaagaaatcgatctttgtcaaaactgttaccaactcttgaaacaacaaaacagtaatggccaagcaccacaagggcaatatgcagatccatttggctttggaagcctggatagtttcttccgagcaatgggcgcaactcccgatgatcaatcacaagcaaaccaagggccacaaacccaaagtggcggccaaggtggcggcaacaacgggcaaaacggcgaaagtctgctcagtcaatacggtgtaaacctaaccaacttagctaaagctggccaaattgatccagtgatcggtcgcgatgctgaaatcgatcgtgttattgaaattctaaaccgtcggacaaaaaacaatcccgtattaattggtgaagctggggtcggtaaaaccgccgttgtcgaaggcttagctcaaaaaattgccgacgatgacgttcctgccaaacttaaggataaacaagtcattcgcttagatgttgtttcacttgttcaagggaccggtattcgtggtcaattcgaacaacggatgcaacaactgatgactgaattgaagcagaataagcaatacattctcttcattgatgaaattcatgaaattgtgggcgccggtaatgccgaaggtggcatggacgccggtaacgtgttaaaacccgccctcgcccgtggtgaactccaactagtaggggccacaacgaataatgaattccgacaaattgaaaaagacgcggccctcgcccgtcgtctccaacccgtttcagtcaatgaaccttctgttgacgaaacagtccaaattctaaaaggactccaagataaatacgaagcctatcaccaagtccactacacagacgaggcacttaaggcggctgcaaccctttctaatcgttatatccaggatcgtttcttaccagataaggccatcgacttacttgatgaaaccggctctaagaagaacttgacgattaccgttgtcgatccaaaagaaatcgaaaagaaattacaaaatgcggaagctgaaaagcaaagtgcgttaaaggacgaggattacgaaaaggccgcttattaccgcgatcaagtcacaaaattgaccaagatgcgcgaaacaagtgccattgaccaatctgaaatgccaaccgtcaccgacaaagatatggaaaaaatcgttgaagaaaaaacccacattccagttggtgagttaaaggcacaagaacaagcacagttgaagaaccttgctgaaaatcttgaagcgcacgtaattggtcaagattcagcagtcgataaggttgcccgttccattcgtcgcaaccgaattggtttcaacaaatccggtcgaccaatcggttctttcctattcgttggaccaaccggggtcgggaaaactgaattagcaaaacaaatcgccaaagaacttttcggtagcacagatgctatgattcgttttgatatgagcgaatatatggagaaattcagtgtgtcaaaattgattggatcacctcctggctatgttggctatgaagaagcgggtcaattaaccgaacaagttcggcgcaacccatacagcttgatcttactggatgaagttgaaaaagcacatccagacgtcatgcatatgttcctacaaatcttagacgatggtcgtctgacggattcacaaggacggacggtcagcttcaaagacaccatcatcatcatgacttcaaatgccggccaaactgatgccgaagccaatgttggtttcggggcaaccctttctggtcagacacactcgattttaaaccaactacaaaactactttaaacctgaatttttaaaccggtttgatgatatcatcgagttccaaccattaagcaaagaaaatctcttgaagattgtcagtctgatgctcgatcaaacaaatgcgatgattgctgaccaagggttaaacattgccgtaactgaaccagtcaaatcacggcttgtcgatcttggttacaatccagagatgggtgcgcgtccattacgacgtgttattcaagaacaaattgaagatcgcgtggctgactattatctcgatcacccagaacataaacaattgacggctcggttggtggaagatcagattcaaatcaccgatgctaaagattcacaggtcacagattaaaaggctttattatctcaagtcaaaacgaatcgcgtgccaaatgaagcgttttcagttatactagtggtaagacttaaacatccagggagggatttagatgcgtttaatcaatgtaaccaattcttataagcgacttgtttcacaacaactcgctgcaacagccgcaacctacgttaaggtttattcacttggtaaaacaacggttcttgactcgcgttcatcgaaggaacgtgagctccttttaaaaaatgatcatcgacatgtccaacaagccgagatcgattttgtattgaaggaactcgccggtttagattccacagatggccttgaagtcttgaatgatggtccattagtcgaaattacaattccaacaccttcaaaaacagtgagttaatcattcgaaccgccccgacatttcattttgttggggcggttttttacataggcaaaataatggcaattgaataggtcgtatcgtataataactttcaacctaatttaggaggattaatgacgcgatgaagacttttcaaaaagagcaccaaattatttgccggttagaagtgggcgacgaaatcctaacagaacttaaatatttggccgcaaccttccccaaccaactgggaactatcacggggattggtgcctgtgatgaagttaccgtcagcgtttattcaccagaaacggatcaatatattgccacttccagtcaagagcaagtagaactgctggcccttagtgggaatgtcgaaaatgcaaatggcacgattgatgtccatctacatgcaagctttgcccgtttagatacaagcgtttttggtgggcatctagaacgcgccgtcatttcacgtacaggagaattaatcgtttccttaattcccgtttccatcggccgcgtcacccatactgcaactaaattacaagtattagatatttaaacgattagaatcactgctatttttgcaggggttcttttttatgcccacttgacgcgttaattatcaaccacactttttgtaatttatgatagactagtagtaataagtaatgcgctacaaggagtccgtatgaatctgattaacctgcttcaatcgttattgaaatggcgcccgaaaaaagcagctcctctaccgaacagtcatgtacgccaaactgtctctgagcaagagcccatccgtcaagcgcctcaatcgtcacagaaacagccggtcgttcccgttagtcaggacgcaacgccactgctggctacgatgtccacacaaccgcgccatagcacagttaccattcactacctcgatcatcatcgggtccctttacgaccaacgatgaccctgacaggtgaagtgggtaccgtgctcaatttgccatggctaaaatttgccggttattacttggcagctattaccaatttaaaacaacagtttcctgaagaaaacaccactatctggcttttttataaaccgcaactcgcagcaccagtaatggtgttacaccagaatttagaaggtggcttgttgattaagccccaatttttatcaggtgctttgaacgaacactatcaagccaatccactagaaggtggtgctaacttcgtgcaccacacctcagctaatcagactggtcgctttacaactaagacacagtttgtccattttaaatatgatccgctgaatttaaaacacagcgatgcacctgaacagcccttcatcgaacttcttgagccaacggatacctatcagcaaccaagtgaagaagcgctgactgctgctcgcttgccaaagcacgcggtttggaagatttatagctgtgcaactgctccatctggcaaacaatggttcaatcttggcagttcttggattacccctacgcgttatcaattacatgccactaatcctaaaggcagtgatgaatcataccaagtaccaaagttcacctaccattacgcagttatcgaaacaacccctctaaacctcagtgcaagtctgaacaacaataccgtaacattttggcaagcaccgtatgaccaacccacaacatatcagatagtgcctaaaacgcgggtagtcgttaagcaagtcgttgtactcgataatcaaagtcgctggtgtcaacttaaaacaggtcaatggttaatggaaggcctcctaacttttgactaaatacccccctaaaaaaaataagccgccgattcagacaacagttagtgtgtctgaatcggcggcttatttttgtttgactctttatattatagttttgcggttaattcaacgtctggatacttatcttggaaccaacgttctgcaaattgattttcaaataagaacaatggttcgtcatgaatatcttttaccaatagatttcgtgaggatgacatccgttcatccaattgttctggattgatccaccgcgcagttcttgaaccgattggatccatcaatacttcagaattatattcgtgttgcatccgatattggaacacttcaaattgtaattgaccaacggcgcctaagatataatcgccagttgtgtaagtcttatacaactgaatcgccccttcttgaaccaactgttgaatccctttatggaaggacttttgtttcatcacgttcttggcagtgacgcgcatgaataattcaggggtaaattgagggagtttctcaaatgaaacagcctctttacccgtgtgaatcgtatccccaatttggaaattcccggtatcatataatccaacaatatcgccagcaacagcgcttgtcacttgttcccgtgtgtcggccatgaattcagttgaattgttcaaccgcatcttcttgcctgttcgcgtcaatgtgacatcaattccgcgttggaattcacccgaacaaattcgtacgaacgcaatccggtcacgatgagctggattcatattggcttgaatcttgaagatgaaccctgagaaatcaggagaggttggttcaaccaacgtttcttcttgtgttttgtgtgcttctggggcaggcgctaagttaacgaatgattctaagaacgtcttaaccccaaagttagtcaaagcagagccaaagaagattggtgtttgttcacccgttgcaatcttatcagcatcataggcattgcctgcttcaccgatcaattcgatatcatcaagggcttgtgtgtaaacagaatcttctttcaatggattatcaccggcaatccgacctgcttcatcaagggccaaataagggttggcttcgtcttctggtcgataaagttcgattcgacggttggcgatatcataaaggccacggaggtcttttcccatcccgattggccagttcatagcacagccttcaatgtccaatagttcttccaattcagcaatcaaatcaagtggttcacgaccatcgcgatccaacttattcatgaaggtgaaaatcggaatcccccgcattttgcagactttgaataatttcttggtctgtggttcaatccctttagcagaatcaatgaccatgaccgccgcatcaacagccatcaaagtccgatacgtatcttctgagaaatcttcatgtcccggtgtatccaaaatattaatccgcttgtcgtcataatcaaattgcatcacagaactggtaacggaaatcccacgttgcttttcaatttccatccaatcggacttggcaaattggccactttttttccctttaaccgttccggcttgacgaatcacgcccccgaaaagtaagagttgttccgtaatcgttgttttaccagcatccggatgagaaataattgcaaaagtacgacgacgatcaaccgccgtttttaattcagtaggtgtcattataaaatcctttccgttattccaatataatgcgcttgggacaaagaattgcgcaaccattgcgtcaccctttgtcccattgattgtgctcatttaatttagtcgacttcttctggtgcatcggtctctggttctggtaacgttaattgtaaatcaatcaaccgtgaaccggaaaccgaccccgtcgttaagctcatgccacctggcagctcaattgtttccggatgaccactgactggaatggcaccaatttcagtaatcacgaacccggcaattgtatccacatcagtgacttgaatatctgtattgaaggcactgttaaattcattgattggcatacttcccataacggtgtaatgctgcgcatcaattttttggtacaattcttcagctttatcagattcatcatcgatttcaccaacaatttcttccaataaatcttcaatcgtggctaagccaacaacgccaccgtattcatccaacagaattgccatttgttgctgtgtgcgtttcatttcaaataataaatcatcaattgtaatcgtttcgggaacaaaaagaggttctttcattaccacttcgatttgcatggcctgaaaacctttttggcgtgcttctttcaagagattcttgatatgcacgacccccaccacttgatccttatcatcccgataaaccggaatgcgggagaatggttgggctaagatggcatcgatgttttgatcgttgtctgcacaaatatcaatcataaatgcatcagtccgcggtaccatgacttcgcgcgccatcttcttattgagggtaataatcccctctaacatttcgtattcatcggtttccagaacaccggcactcttcccagattcaatcatgtggaccatttcttctcgggtgagcttcggttctgtttctgaaaaatcaattggtgtcaacttcattaagagcgaggtcgacattgatagcaaccacacgaatggtcgcagtaagataccgacgatccgcacgggttgcaccgttattttagcaattgcttctgcacgatgcagtgcaacttgcttaggatataattccccaaaaaccagggatacataggataagacaatcgtcacaattaatacggccgcttcctttgtccaagccgcatttcctaaaaggggtgctaatctacccgcaatggttgtggcagcactcgctgaagataagaagcccgcaaacgtaatcgcaacttgaattgttgctaaaaactgattggaatgacctaagacttgaactaatactcgcgccttcttgtcacctttattggcttgctcctccatcttcacacgacttagtgacacaagtgcaatttctgccgcagcaaaaaaagcattcactaaggtcaaaattaatatcaacagtaactgtccccacaccgaacttccagggtcaggattcatcgtcacatccactacctttcattatctaaataagtacatttagccgaatatggcctaccttgcagtatagcatagtcaaaaatggaaattcaacctgcatcttttaaaggtcggtcccttttttagctttagtccgtaacgcttgaatatcatataaataagtaatcactgtcttggtaacagcataaaacggaatcgctaaaatcatgcctaaaatcccataaatattcccagcaaccaataagataatgatgatggttagcggatgaatatctaatgaacggccaatcacgttaggataaatcaagttcccatcgatttgttgaacaacaatgacgacaacaatcaccatgattgttttgggaatcgaaattgataaactgataatcaacgcgggcgcaatcccaatataaggccctaagtatggaattacgttagaaacgccagcaataaatcctaacaaataagcgtatggcatcccgataatgagataaccgataaatgtaaagacgccaacgaataaacactctagagcttgaccaccgatataagctgaaatcgtcgcccccatcttccgaagcaagtccgccacttggtcgttataacgatcaggtaacatcttttgaatattaggcactaaacggtgtccgtcttttaacatatagaacaacataattggaatcgtgaagacactaactgtaacgctcgtaatcgcaccaatcatactaccaaaactagatgtgaaactcttcataactttttcagcaatcttcgatggttttaaatctaactgattgacgtatttattgaagtcaatgtttttcaagcgcggattgctagataaatcatccgctactttttgcagtcgatgagcaaaatctggtaggttcgtcacaagttgtgtgatttgtttaatcaagttaggaatcacagtggctacaatgaaaattaaaccgccaaaaaagacgatgaagataatcgtaatcgcccagttgcgtgatattttgagtttacctaacagattgattagcgggttaaacaggtaaaataatagtcccgcgccaataattggcccaaataaagttgaaataaaggtgccaattggatcaaataagaaactaattttggtgcaaacaaagattaacacagccaaaatcaaaagctcaattgaccaaaataatagttttgattggcgtaaacgatcaaacatgcagtatccctccagtgtgcctgtgtcacacaaaacgcattttatgctatcatagtgtaacgattatttttattgtaccaaattttatagtgatacacattgattattccttttgaagaggtgtttttttaatgttagcgaaacaaactcgtgatttaaaaagtacggtttatcaagatagtttggtaattcggcaagccgtattcgttgttgaacaacacgtgcctgctgaacttgagattgatgaattcgaagaccaagcgatttattttgtcggctacgttgctgatcaagccgttgtgacgttgcggctcatcgaagcggactcagattatcatgttcaacgtgtcgcagttagccgttcagcacggcatcatggttatggtcaagaactgatgcgtgccgctgaagtttttgctcgggaatcaggcaaagcaacgctcactttaaatgctcaattaagtgcagtaccgttctatacgcagcttaattttcaagcaaccgccaaaccacagttcctagatgccgggattatgcatcaagaaatggttaaaaaattaactgactaattgtcatttcaccactaaatgacttataatgaacacagcttaataacagaaaggacgttaccatgcctaagcaaaaatcacttcttgtccacttatttttcttcattatcccttatctactcgtcattacgattgccgcaacggcttacgacagtcttgtgattcacagtgccacttgggatcgcaccttgttcagtgctctaatcagcagcaccttaatgttatttattaaagtcccccttgaacggccattaacaattatggctgacttagcgcttaatcgaacactcaaaatgttaacgcgtttctttttagtcgagcgctccttgggggttaagattgccaatttcatttttgatggcattcttttctgccttgcaacctatctgttacgccacttcttgccactcaacatcattgctggtagtttactcggctggtgcgtcttcgcgcttttgctatccatcagcatcggtgctggcatcggctttaaaacattaacgattcaacaagatacttcagtcgaaaacgattaacccatacaaaaaagctccagtcaatcaatgactggggcttttttgcttgagactaaatagtgttctaacgacggtgcgccaattcttgataccggttataccaaatatcaatgtattccttcgaaaagggccctttgccattgttgatccaatcaaccaaaaccttaacgttggcttttaaaatccgatcagtttcggcggaataatgccattgcgcactgtgcgcttcatattcatcgacatctagaagccgtttttcgccattggggaaaaccttcacatctaaatcataatcgatatacttaagcgcctcttgatccatgacatgcggcgatgccaaattacaataataagaaacgccgccctcacgaatcattgccaccacgttaaaccaatacttcttatggaaataaataagtgccggctcccgcgtgacccactttctgccgtctgactctgtaactaaggtatgatcgttacaaccaatgactgcgttctcgctggttttcaaaaccatcgtatcgcgccaagtgcggtgtaaactcccatcgtgtttataactttgaatcgctatatagtcgccttctttgggaatactcatcgacatacccagctttccaaggttattattcataatcacctatcattatagcaaagactcgcaaatttacctaaaactttctaccattaattggttgccaaacgtgccgctaacttcttttgcacagtcggtaatgcaacgtcagctaattgtgcctcggtataccattggcctgggaaaaaggcgaggtcggcatctgctgcaagttgtgcttctaaaagggtaatcgtccatttaagatgcgtaaaaacgtgcaccacgggttttaaacctgattcatgtaattgctgcaattctagtgcaaaagcctctttaaaataagtttcgatacgagctaattgttcttccggtgtcaataattcatcgtcggttgcttgcaagtcttccgcagcgactagtggataagtggacaggttcgctaataaaccggtactcggtcgtttttgaaataataagcccttttgcgagcgaatcacaactgcaaacatcgcaaccggtttttgttttgctttcttcgtcttgactggataatccaataaggtgccatcttgataactccggaaaaacggtgccaacgccgtctcaccaaccgttggattctttgccgtacaaacttgcgaaccaaaatccatcacggcttggttaaagtcacctgggcgatctttgggaatcagcggtaaaatcgcatcgtaaaaaatgtggcggttctttggattggcaatatcagcatcgattttcaataaccgactgaacacccgaaaagcattgccatcgattgctgggacaacttcgccaaaacaaatactggcgatagcgcccgctgtgtacggtccaatcccggctaacttttctaattcagccgcggttgttggccactggccattgtagtcgtcgacgacttggcgcgctgctttttgtaagttacgcgcgcgcgaataataaccaagtccctcccacgttttcattaataagtcctctggagcggccgctaagtctgccaccgttggaaaagtcgccaagaacctttcatagtacggaatcactgtttgaacctgcgtttgctggagcatgatttcagatagccagacacgatagggctcttgattctggcgccaaggcaagtcccggcgattttcatcataccaagtcataaacgcggtttgaaacgcatcccgttcactcggtgtcatctgatagttcttgttcgtcgatgaagtggttgattgcatcaatattaaatcctttccgatacaacgcttgttgcatcttcatccggcgttctcgtggttcgagtaatcgataacggcgccatttttttgcaccaagttcagcaagcgcgtcagcttcactatcttcatcggcttcaagggccaacgcttcaataattaaactaaggctgtcaccgccaaaccctttttgcattaaaccttgtttgactttttgctgctgttcaaagaatgaactatgacggtatttcttcgccaacttcttagcagctgctaacccaaccgcaacttgatcatccactgaataatgactaagtgcttgatcgatatgggcagcactaacacctttttggattaatttctggcggactactttggggcccttatcagcggtattaatcacagtacgaacgtagctatcggcgtaatcctgatcgtcgatataatgtaactcgcgtaattttgccaagctagtctggatcccttctggagtgatctcgtgttcgcgtaaatattgcgttagttccttttccgtccgcaattggtgactcagataattgagcgccaattgatacgctttggcattatcatcgtctttttgaatgtcgcgttgcagttgactatcaatctctaaatccttcgctaaacggtatttaatcaagacactctcggtcacgccaaaagcgaattgctcatcgataaaaatattataacggcctgattttttctgtgccgttattttggtaatcttcggcatgttattctcccttgttacgtgttgctttgatgtttaaatagactttaaatccaatgaccacgacggcgagcactaaagtcccgatgatcagtggtaagctcttgtgttggaaggcataaacgccaattccgagtacaatcagcatggcgattaaaaattgatttcgttcccaaaaattcatgtggcttcgctccttactttgacttcctgtagcatagcataaatggcgcacccggacaaaagtcactgcctaattcccactattgaagcgatttttcagtgctaagtctgttatactgaatgcaatgagaaaaacgagtatcattattttatattaataggagcggattaaatgccagaacaaacaaaccaagtcgaagtcggccaacgttttccattgacgattaaacgaatcggcatcaatggtgaagggattggctattacaaacgcaaaattgtctttattccaggcgcacttcctgaagaagtggttgtcgcagaagtcaccaacgttgcccctcgtttcattgaagcaaaagtccacaaacttcgccaagcttcaccacaacgggttacccctaaggatgccacttacggccaagtcggtgggattgagcttgaacacttaagctatcctggccaacttgccttcaaaaaagacgtcgtcgtccaagcgcttgaaaaattcaaaccacaaggctacgccaaatacaatattaccgatacagtcggaatggaaaacccctggcattatcgcaacaaagcacaattccaagtccgcgaaatcgatggtcatttagcagctggcttatacgctccaagtagccatactttaattgatttgcctgaattcgcaacccaaaccgatttaacaatgaaaatcatccgaaccgtcttgaaattagtcgaatcactcggaattcccgtctttgatgaaactaagaatgccgggattttaaaaacattggtcgttcgcgaatctttttcaaccggtgaagcgcaactgaccttcattaccaactcccctaaactaccgcaaaagcacgccttgattacagccatccaagctgaattgcccgaagtggtttcaatcatgcaaaatatcaacaaagggaaaaacgtgctcgtttggggcgaccaaacgattcatctggctggtcaagaaacgattatggaaactttaaacggcgttcacttcgaattgactgcccgcgcctttttccaattgaatccagttcaaacggctaagatgtataacttagttcaagatgcacttgatctcacacctgaagatcgcctcgtcgatgcttattgtggggtgggtacaattggcttgagtcttgccaatcaagtcgcagaagtacgcggcatggacacgattgccgattcaattgaagcggctaaacacaacgccgccatcaatgacattcaaaacgttgaatatgccgtaggggctgccgaagacctcctcccagaatggttggataatggcttcgtcccaactgccttggtggttgacccaccacgcactggcttagatcaaaaattaattgatgccattttagacagtcggccattgaaatttgtctatgtctcatgtaatccatcaacccttgcacgggatttaaaagcccttgtgcatacgtaccaagtggaaaaaatccaaccattggacatgttcccccaaacggcacgagttgaagcagttgtgacattaacactaaaacgcgacctataacgcaaaaaagcggtccatcaacaaacacatgttgatggaccgcttttttatttggactttaatcgcctaaacgtgttctataagtcatatccttccggttaaccctgaatggcaaacgattgcttcacaatcattcgccaaacttcgttaatgctcagaccgtttcggttgtgacgcactctttcttaagaagaaagcaactagtggattgtcgctgttggttgtaatcgtgtctgttttcaataacgtgattataaataaagttaaaccgatcaacgccgaaattaacgtccatgcgcgcccctgattgcccgatgtaaaacgggatgcaaacccgttcaataaccacaatacaactgctccgcgaccatttaacccagcatcccgataacgccgtacactaagcgccaacgttggaataaacgtgagtactccaagcaacccgataacgattatgtacagcactaatgcaccgctcatcttcagttgcacctttgcagcttgtgcaaatagcaaagcgaaaaatggcatgaaccaaacaatcattaaaatcaacatcgcccaccaataacccgcacgtgttgttcgccccgtaaaatcaaaataacctttaaaataatctcgccaagctgacttaaacgttacttgccctggtgtttcttgaatctcgcgcattgtgaatccccttccaaaactgattaacttaattgtaccgcatttcaccactaatttgatacaataaaggaaatcaacttggaggaattcctatgaaaatttatttcgcaaacgctctattctcagcagcagactttgattataacgctaaggttgttgctcaactgcgccaagcaattcatggtatcgatatctatcttccacaagaaaacgccgcaattaacgacaagaatgcttatgccagctctgaaatgatcgcacaagccgatacagacgaactcgttgctagcgatctcgtcattgctgttttggatggtcccaccatcgatgttggcgttgctagtgaaatcggtgtggcatacggtcgccaaattccaatgatcggattatacaccgacagccgccaacaaggtgctacaaatccacaaaaactagcggctttgcaagagatcgccgaaaaccaattccattacttaaacctttacacaaccggcttaattaaacaaaacgacacgattgtgaataatttagacgcgttgattgaggcagtgcaagcccacgcctaattaaaaataaagccattcatttgttatctatagtgaatggctatttatattgtattttgagcataaaaaaaggattcaagctttgatatgcttgaatcccctaggttgaggttgatagcttggttgttacgagctgattctgttttacattctggataatgttacacctcatactttattcaattgtttttaatcgttggtctagcccactgctaatcgtttcactcgatctagtttggtcgtctatctttgacccgcatgtgcagttttagcgatgacgattaaattcgtgtttactacttgagcgatattctttaacagacatcagcctccgatatacttagatcttaatactacgaagagttacacttatgtttccattggaaccacgccttgcaatttctttttcgtactttaaatcttgatgtgtcgtacattcaaatctggtgcttgtgttttaaagtggtaaatctatttaaagctaacttggtttcacttaccaagctatctttcctcaccattaatatagcaccttctgtgaccggatacaatcaaaatgctcttaaatttaaaaaagtttttccatcatttctgacttgttatttttatcagaaatagctaaaaaaactgccattaacaatactgttaatggcagtttttaggatacatagctgtttttttattaatctctaacttgataattgcgttcgtgttccttaacaccttttaaaatgattggcgcgttgtccattgccaaatcaatttcatattcgctaccgtcttctggtagttctgcttggaattgattttcgtattcagccatcgtcaattgacgtcgtgcagcaagcattgctttgtggtccgcaccggctaattgtttttcaaatccgggttgcaaaataccggtgaagaattcactgattgcacctgaaccgtaactgaataaaccaattcgatcgccggctgccaattgcgttgattgttccaacaatgaaaggaagcctaggtataacgcgccagtatagatattaccaatttgacggctatacaatgtgctttcttgataacggtctaataaatgtgcttgttctgtttccgttgcttctggcaagattgtccgcaatgccttcaaccccatctttgtgtatggtaaatggaacgttaaggctttgaaatctgagattgtgcggccagtttgagcgcgatagtctgcccaagttgcttggaaaaattcgatgtattgttcagttgaatatttgccacgcgcaaaagcttcttttgaataattagggcgccagaaatcttgaatgtcatcactgtgaatggccgttgccggttctaacgccaacaaacgtggtgctgcactaacgatcattgcaaccgcgccagcaccttgtgtcacttcacctggtgtatccagcccataacgggcgatatcggaaccgatgactaatgctttttgctctggatgcgccgctacaaagtcataagcggtcatcaaaccagcggttgccccgtaacaagcttctttaatttcaaaagcacgggcattttttaatcctaataagcgttgcacataaagggcaccggcttttgactgatcgattcctgattcagtgcctaaaattaacaaaccaattgaatcacgattatcatcatccaacacttcaagagccgcgttagccgccattgtgacactgtcttgactgaggggggcaattgccatttgatcttgaccaattccaattgtgtatttgtcaggatcaacgcctcgcgcgttagctagcatcactaaatctaagtaggtattaggcgtaaaaagacccatcttatcaattccgatttgcataataatcttccaatctatttgttttcagcacgcagttgcgctaacagctcggtggctgttgctgtatttaaatgtgtcgctttcaataataatggtaataattgcgttaattcagtctcggttgcgccagcggcaatcgccaacgacttcgcttgaagcgccatgtgtcctttttgaatcccgtctgacacaagtgctttgagcgcggcaaaattttgtgctaagccaacagctgcgataatgccggctaattcacgcgcattctgaacttttaacaagcgctgattaatctgcacggttggtagaataccaatcgatccgccaaccatcccaactggcagtggcagttcgattcgaccgcgtagttgctgatcagttgtccattcccaactcgaaagcggttggtaagcaccctttctagcagcataactatgcacgccggcttcaattgcgcgccaatcgttgcccgtcgctaacaccactgcatcgatgccgttcataatccctttattgtgggttgctgcgcgcgccacatccactttggcaaagtcactcgccgcaatcatcttttcggcaattgtttcgccagcaagcgtcgcagttgttaaggtagctggatcaatcgtcacacttgcggtcaccacggattcaaacgcggcattggtcaaaacactcaataaaagggtgccgcccaactgttcttgaacagcatgtgcgatcgcttcacagattgtgttcacaatgttggcgcccatcgcttctttggtatcaatttgcaattcaagtttcaaaaagcggtcgtcaataatcgtcggcgtgattttttgaagaccaccaccgcgtttaacaattgatggatgcgcagcccgcgcaacttcaaataaatggtcattgttgccactaatccaagctttagccgctactaagtcaactagcttctctaacacgacttcaccagtcatcagccgcgtcagttgttcagtcacaaagccgccattagctcgtgccatcttagccgcattattagccgccgcaataacggatggttcttcgatcgcaaacgggacttgatagacttgctgattgactaataaatcttgcaccacaccaagcggtacttggtactggccaatttggttttcaatcatattaccagcgatctcatctgacaagggttctgcagctgctaaacaatcagcatccgtctgacttaggtgaccttgttcaacaagcgttgctaaacgttcatccttcgttaattgatagaacttaggctttttcattacaccatgcctcatttaattgaatttcaaaagcaattcctaacccgccaccaatacataacgaagcaatccctgttgtttggtgcgtccgtttcaattggtgcattaacgttgtcatgatgcgcgtacctgaagcaccgattggatggcccaacgcaatagcgccaccggccacattaactttagcaggatcgacttgtaacccattttgaacggccacacttgaagcggcaaacgcttcgttaatttctaataaatcgatatcggctaatgtttgattttgttgcgctaataatttttgaattgcatcgaccggcgtgtaccccatgtaatctggatcagcaccgacttcttgatagccgaccaaagtggcttggtaaactaatccgagtacagcagctttttccttgctcataacgatcatggcagaggcgccatcgttaatgccggaagcattggcaggtgttacagtcccatcttgttgaaaagctgggcgcaacttcgccattgcttcgatggttgtcgttgggcggataccttcatcttgttgtacttcaagcgttgctttgcgttgttgcaccgttacaggcacaatttcttcattaaaccaaccagcttgggtcgcttgcgcggctttttgatgagaagcgagtgcaaaagcgtcttgcatttcacgcgtaatgccgtatttagctgctacattttcgcctgtaatccccattggctggtgcgtaaacgcatcgtttaacccttcgctactgatgctatcaatcattgtttggtccccaaatttactcccaaaacgcatttgtttattcaaataaggcgcttgtgacatactttctgtaccgccaactaagacgatgtcagcatcgcccatgacgattgcactctgcgccaaccgaatcgcttttaggccggagccacaaacttcattaactgtcattgctgtgcttgattgtgtcatcccactcttcaaagcgatttgccgtgcaacgttttgcccagaaccggcttgtaagacattcccgaaaattgcttgatcaatctgagttggatcaatcccggctgcttcaatcgccgctttagcagcaactgtccccaattcaaccgcgcttaaacttgcaagttggccccccaatttaccaatcggtgtccgctttgcactgataataaccacttcttgcataatatccctcttcatctataagtctaattattactataactaaattttcatgaaacgtctggtaattcataatttctttaactttttttagaaatccgcttggtaagctgagattattttaccattttatcggcatcgtgcattactcattagcgtaagtcattcaccggtgacgcttacaactaatctttaggaggaatccacatgcaaacatcatggttagcaacatcgatcgcttttgaattacaaaatacagactatccaaatgaaagtttacaacgtcgtatgaccgccgtaaaagaagacgttcaagccacggaaatccaagcagttggcgaagccctcgcaagtctccacgcaggtgacacatttgcaacagctactctaaccactaaatctgcttatatcgctaaataaaaaacatatcaatctttgaggaggaattcaagatgaaacaactttgcttagaatttaaaaacagtgatgctaagagtcgtgtattgcgcttaaacaatattgatgacaacttagacgccgaaacagttagaagtgcgatgactaaaatcgcagcagccaatatgtttattaaaaaaggaattgaactctacaaagaaccagttggtgccaaatacgttgaacggattgaaacaccaatcttttctgacaaataattaagcagcataaagcccccaaatcgaatctgatttgggggctttttttgcgttttacataaattgattaacaacccttgtttccgcgataaactttggtgtaggcttacataaagtcgttcaaaggagttatcatgcccaatccatttaacttatcgcaaatattgcaatcaatgttgcttaattgtttactggtaattgcgctgccactagcttttgccgggattttaacactaatcaatcgttcaactaaacggcgcttagcccattggtgggattactcacaacttttaattggcggcctaggcactgtgattcatgaactcagccatgctgttgcctgtttaatcttccaacaccaaattatcgatatgcaactcttaaaattaaatttacgggataaccccgatcactcgcttggccatgtcaatcaccgataccatcccggccgtctttggccaacaattggtaatctctggattgggattgccccgatttttggttgttcagccgccattttcggactgacttggttattagcacggcccacttttgcaacgtggatgacctttgctaaacatcccacttggcagttaaacgccatcggccccttgttcagccagctctggacgacgcaaccgggtgctctcttgctctggttaatcttaactagcatgattgccatcggtggttatgacttatccgcagctgattttaaaggcacgattccagggattattgccacagtcatcgcggtctgcctcgttactggtctgttttcatttgtgccaacagtcaacaccacgacttggctcattggtgttctaacaccaatggcaattatcctaaccatcgccgttagcttgtcgggtgtttgttggctgatcattgccgggattttcgcactattagaaaggacgacttatcatgcgcgtcattgacttactacagctattagctgatacacccaaaaacgatggcatctacttcgaaggccctgaagagctccaacctatcgcccactttgagctcgccgtcgttgacgaacagccacgactattactgcagttaaaggccgcagacaaaaagccgctgaagcagtgggaatttagcctattattaaatcaaaaaaactactaccaacattatatgtatgtccaaacaaagacgggggactatcctttgtttggttttcgcgttgctgctgacaaaattctactcggataatgtttgttcaagttgcgttaaataacgatgactcgcaatcatttctcgtgcatcattttgatcggctaattgaatctcatagatcgaactagcatcaggatttaacaatggcaatacgcgggcccagtcaattttgccagtccctaattgcaacccatcatgcttcaaacccatcgaatcaaccagatgataatggacgacgtgctcacgcaaagttgccagactctgcaagaaagcattctgatcaccctgcaacttgataaaacagtgactcgtatcaaacgctaagcggtaacctttatcaaagatggcctgatcaaaaatcggattgccataatagaaaatcggtgaaattgaattttcgaacataatattttgtccgccaatccgctgtaaataatcgagacgcttgaacaaaacacgagtggcatccgtaatattaccgtaacccgtcgtcaattcttcaattggatcatcataagagccatgcaccaatagttggacatcttcagctttcgctaactgcaataaatcaagtgttgattgccataaaaagcggtatcgggctggcgaacttgcttcattcatcgacagttcaatatgatgcccttcgaaactcattgggtggtgtaaaataatccgttcaacctgctgactgcgtacataacgaattttttcgcgtaagcgtactagcccagttggcgtgacatcttcggctgttaaatgaaattcaaaatacgttggctgatactgcattcgatcagcaatttgctgatcgttaatccctgcttttaagcctaatcgcatcgtaatccctcttttctctactagttcctatttctattctaacattctaaagacctaagaatcgtaaaagcggctcaccaagtaatggtgggccgcttttttggttggcgttaaacgtgctttttgaaacgcacgctatgcatttagtaccttgttcaggaagtcttttgttctttcgttttgtggagtgtcaaagatttcctgtggtgtgccttgttcgacaatatgtccatctgccataaagatgacgcggtcggccacttctttggcaaagcccatttcgcgagtcacgacaaccatcgtcatcccttctttggctaaccgcttcataacggccaacacgtcgccgaccatttcaggatcgagcgctgatgttggttcgtcgaacaagagaatatcaggtttcatcgctaaggcacgcgcaatggcgacccgttgtttttgcccacctgatagcgattgtggttttgcatcgaatttctctgataaaccaaccgtttcaagtagtttcttggcggtttcttttgcttctgccggcgtcattttaccgagttccactggtgcgagtgtaatattttcagcgaccgttagatttttgaaaagattaaagtgttggaataccatcccgattttttcgcgaatttgattcaaatcactcttaggatcactgaggttgtacccatcaacgataatctcaccactcgtgggttcttctaagcgattcaagcagcgcaagaacgtgctctttcctgaacctgaggggccgatcatgacaaccacttcattatcaccgaccgttaagtccaaatcttttaacacttcgttactgccgtaattcttaataagatgagacacttcaattctattcattagttatctattctcccctcaatgtacttcgataaccacgtgagtaacgtgataacgatcagatagattaaggcaatcattgcccaaattttgaacccttcaaggttgcgggcgatgataattttacccgtctgtgtcaattcgagaatcccgatgattgataaaattgacgtatctttcaatgtgatgatgaattggttaatgaaggatggaatcataatgcggatcccttgtggtaacacaacgcgccgcattgctttaccatatggtaaccccaaactccgcgctgcttccatttgtccggtgctaaccgcgccaatgccccctttgacaaaggctgcagtataagccccttcattgaacatcaacgtgatgaccccagccacaatcgctggaatcttctgcccagttaaacttggaatcccagtatagatgaataacgcaagcaccaagagtggtaacccacggaaaatatagatgaccgtatctgaaacgccacgcgcaaaccggttaggtaatacgccgagtaaaccgaagaagaccccaaaaatggttgcgaagaaaatcgcaatgactgttaataataacgtctggcctaaaccgctcaacaacgcatctttattttctttcaataatccaaaaaagctgtgatcaacggttgcttttttagttgattctgtacttaaatattttgctttaattttgtcgtattgaccatttgcttttaatttagcaagacctttattgaatttagcgatgagttcaggattgctccctttcttaacggcaaatccatattcgccaccttgagcaggtttggtgacaatcttgagtttcaagcccgtcttaatcccatattgcataacgggctcgtcttcaaaacaggctgccgaattaccattcacaacatcattatacatattatctgaatcatcaaacgtaacggtggtaaagccatattctttcgctttggccgtcgcataggccccagcggaagtccctgttttaatcgcaacacgtttaccgcgtaacccttctaagcctttaatcttactgtccttttgaacggccattacaaccccggtcttgtagtaaggatcagcgaaatcaaattttgcttgccgttcaggtgtaattgtcatcccagcaatcacgccgtcaatttgttccgattgaacggattgaaccgctgcgttgaagcccaacggtttaatattcactttaaagccctcggacttcgcaattgccttcatgatatcaatatcaataccgacgtattgattcttctcattcgcaaactcgaatggtggataggtcacatccgtaccgatttcataagttttttcagcggcttgaacctgattattcacttgactcccaaatacaaataagcctgcgagtaaacagctgcctaaaaatacgagtaatttcttcatgtgatcttcccctaatgcctgaccaacttctctcatcgctcttaacgcgttattaagattagattagacgttttataatagtatgttaataattataagcataaaatccaaatttgtcgaattttttaccacaatattgaaaagcagactctaatccctaaataatcgcattaaaaaagcccgcagataaggcggactttcactaaatgagaattgaatgagtttatctttcgactgaacgtgaaaccgctgcaataaaatgccgatatcctgcaattgcaatttttaattctgagatggcttcatatcgattgcgttgcgcgtcgccaatatgttggatatcaaagcccagttccttattccgaattgctaattgacgaatcacatcaggttgtgcggattcttgacttgtcccaattgctgacaatgccaatttgcctttagcatgaatcttgtcgataattctcttaatttctgaagcaccgattccccaaacagtgcctactgctggtaatagaataatatcagccccagcatctaagtagttatcaattgtttcatcagtaaaaatgggttctgaactaccggctttatgcatcttaccagcgattactaagccattgaattcagtctttgcaatcttgatattatccgtgattgctttatttgatgtcccgacacctggattagctgttaaaacaacaaaatcaaaccctaattcaccggccttccgcaacgtctctgcagatgcctgccgtccttttggaatcgttagtcgatcctctaacattggcgcatcaagatcaatgggttctaaattcaaaccaattgggcgaccaataaattttttcaactctttaatcacattatcatttagaatcgccgtgtttattgcttcttggttaggcatccctaatacgattggattaaacacatcaaaagcatttaataaaatcatgtctgccccagatgcttttgtcatttcacttgtcgtaatgccttcttcagatggctcgtgcatcaccacattttcactcatcacaattcgaccttcacttgattgaatagctttgaaaagatcgtccttcgtataagcttgtacatcacttgcattggcacttagtaatcgtttaaccatgattcatcctcctaattatgcatctgcttctaatttattttgtgctttaacttgttgttggttcgcaaaactaatgaatgggaagtagatgaaaattcctaaaataatgttgacgagctggattaccgcacctgataaactattcgttgccaaaaatcctgagaatagaactggcatcgtccacggtaatacaacccccgttggcattgcaacccatccaaatttcatactcagatacgtcgttaacgtaaagaccattggggtgataatgaatggaataaacataagcggattaaagacaattggtaatccaaacataattggttcattgatgttgaacaacgacggtgctacagcaagcggcgttaacgttttaatttcagcactcgacttcttcaatagaattaaaattaacatcgctaggaccaatgataagaccgaccctgaaccacccataaagacgaaattatcaataaatgagtttgtgaagaatgcctttggtgcctgtccatgctgaatagctaatcgattcgcatcagaattcattaaccagattgggttcattgcagaattaatggtcgtcccatgaatgcccatcgtccaaactagaccgttcaatccgaccgcgattaatgtgccgaaaattgtcccccctaggaatgttaatggtccgtgcaatacctcgagaagtacaacatgcacattatcgaatcctaaagcaccgattataatagcaatgattccccagaaaataataattacaatccctggtattaaagcactgaaggtttttccaattgctggtggaactgaatcaggtagcttgatttcaatattatgtttaataaacagtgagaaaatctgtgcagttgctaaggcaatagtgatcccaactaatagtcccttgctacctaaatagtttaaatcaacacctgtaaccccatctttagcggtaatcactggtgttacgaagaggaatgacgccaaggcaatgaaccctgccccaattgatttaacttcatcagtaattgaacttttagtgtaactataggccattccgaaaacagccggaatagccatgacaccgaaggtcatattgttagccaacgttaataactgactaagattaccaaaatagggtactttaatctttgttaatgtgtctgtccacccatcaatcggtaaactattaataattagcggaatactcccgataattattaacgtaatcgcaaatcccatcccatcacgaattgccattaatcccttattttgtgataattttgacgcaaaaggaattactttatcgttcaagaaactacgcttctcttttgtcataaagtctcactccattctgatattttgtttgatttagacatcatccaccaaaataatcaccccttaatgttatcgcttacataaattctaacatatttttctaatattaatagttataaataataccttgtttaatccgatattattggttattctctcaatccgatctgttttcaatccttgacacagataaaataagagtggtctaaatttataaataacagacttaatttgctataatggaagaactactactcaaggagtctactatgattaaacccattatgcgtgacactcaattcttagctcaaaaagcagttccagcaacactagctgataccgatgtgctgaccgatttacgtgatactttacaagccaacacagaacgttgcgtcggaatggctgccaacatgattggcatcaataaacggattatcatcgttcaaatgggcgtcttacctgtgattcttgtgaatccacagattgtgcgccaagccaaaccttatcaaacgactgaaggctgtctctcattaaccggagaacgtccgacaacccgttatgaaacaatcgaggtcacttatcaagaccaagccttcaaaccgcataggcaagctttctcaggctggattgctcagattatccaacatgaagtggatcactgtgagggccgtattatttaaaaaacaacaaaaaacgttcaaccattccaatgttcggagtggttgaacgttttttacaggttatttattttcttttttagtgtctttttttaattcttctgctaagtcgatgatgtatttcttcaagtcatctttcacttctgggtgttttaacccatattcgatacttgtttctaggtaaccgaacttgttcccaacatcgtaacgacggcctttgaattcgtgagcgaagacgcgttgggtcttgttcaattcatcgatcgcatcggttaattgaatttcaccaccaagccctggtttttggttttctaaaatatcaaaaatttcaggcgttaacaggtaacgaccaatgattgctaaatcactaggcgccttatcaacagctggtttttcaacgaagttcttaacgttgtataaatcatctttaactttgttttctgggttaatcacgccgtatttgtccacttcattatgtggcaccttcataacggctaattgtgatgcatgtgtttcttcatattcattgattagttgtttactcaatggcaccttatcttccatcaagtcatcacctaacataacgacaaaaggttcgtcagcaacgaatgattttgcaaggcgcactgcatcccctaatccgtttggatgtgattggcgaatgaagtacaagttaacccccatatcagtcgtttcgttgaccatcttcaacatagcggtcttattcttggctttcaagttttgttccaactctggtgctgaatcaaagtgatcttcaattgggcgtttgcccttaccagtaataattaagatatcttcgatccctgaagccttcgcttcttccacgataaattgaatcgttggtttatcaacaattggcaacatttccttcgccatcgctttggtagctggtaaaaaacgagtgcccaatccggctgctggaataactgctttacgtactttcatctgctaaaatcccccataacttatagtctaataacagtatgccataaaaaagtggatttgcaccaattatatgccgaaaatgaggaaaagattaacaagcacttaggattttatcaatcttttcacaattgttttgtaagcgattcccatcattggtattctcaagatgttaacaataaaggaggtcttcgatgtttctactacatcccaaacatatcaatacatatcacgagtgtcttcctgtgccactcatcatcaaacgtggtattgattataacttctgtgagctggatcaatcgtcaattccccgttcttaccaaactagtattacgagtgacacaatggtgattattccctataaaagatcgcaaagtcttgtgttagaccgcataaccggtctccagattagtccgcgttctacccggcaactaatgcgcgcttataatcgccatcagatcatggacttctcacaaccccggtatctttgccattgtttcaattggtatcgtaagattccacacatcaatggcgaatatcagtatttaccattaagtggcacggctcatcaaaacgcaccgtggttagcgctccactacgtccgtgattacgaagttagcgataaccatctctacgtgacattgctaaatgactgtacctgtatcctcccttataaaggccgtcaaatcgatactgaaattcatcaatgtgcagccattggcaaagtccaacttggctgtctcactgtgtgtgccactaatttcggctatcaaatcaagctcaagacttgtttcaagccaagcatcgtccatcgcttcgatgattgccactgccatctgtgctcgaatgttccgaaaacagctactgaactactcggattactcaacgcacttaaaatgcataaggaaaatttcatttaccaagccgtaatccatgaataccccgaattcagcgtatttgacattcagtgctatatcaaaagtgttaaagcactaattcaaaaattacaccaattataaattaacccgaagtcgctatttacaataattttcatttgtatttcaatgcatttgcgcaaattaaagctgaaacggattgatttaccgctaaaatcggcgattacccttctttatgcaaacccgctatagtgaacttaccggtaattcacactgtgagctcatagtagacaggatgctttacaatgacccaatcagatttacaaactgcttttgattttattatacaagacgacaccctcatctatggtgttctcaaagatctccacgttccaagacaacgtagcaacttcgccgatctctaccaaatcggcgtgattgcctttgtcgaagcctacaatcatttcccaggcaatattgaagtcgaaacccaccgcttcatggtttacgcgtatcaggccgttaaatgggcgattatgatgaccttccgcaaggataataaccatgacaagcgaatcggcttcgttaaccgtacaaatgatgatgattccgtgatggactacctcgaccaagtcgcagatccatactgtaacccagaagacgccgccatctgtaacgacctcttcgaacgcctctatcaagtctgtacaccacgcgaaaaacgcttcttagttctgcgttacttctacaacgccagcctaaaagaaatcgccgcggatctaaacatcacacggcgaacggctaataatattaagtttaaggtgcagaagaagtttagtaagcttttagtataaaaataagagacaaaacacttatcagagaatctgcaatactctgtagtctaatagtgttttgtctctttttataaattaatttttactatcttcagttatatttaaatcatttttaatctgactcgttgaaatgccttctgttctaggtagataaatgacttcgcactgatccttcagaaaatcaaattgacctttccaatcatcacccattacaaacgtatcaatcccgtatttttcaacatcagttttcttttgttcccaatttgtttctgggataacttcatccacatacttgattgcttctaaaatatacttacgatgttcataactgtgataggcttccttatgtttaattcgattgaactcgtcagtggaaattgcaacaattagatagtctccaagcgatttggccctctcaagcaaatgaatatgtccccaatgtaataagtcgaatgtcccatacgtaataacttttttcatagtacaactcccccatttgtattacttctcgatttttgccataaatttttgtaatgcatcttgccaggttggtacttcaaatccagttgccttaatcttcgttaaatccatgattgaatgtcttggacggaatgctttttgtggatactcgtcggatgttactggactcacttctacgtctttatccttcaagatttcgctcgcaaattcataccaagtacatgaattgtcatttgaaagttgatacaagccatacggcacgtcgttttgaacagcgtataacatgaattcagctaacgtccgagtccaagttggacggccgacttgatcactaacgactgttaaatgatcatgcgtcttcgcaagatttaacatcgtataaacaaagttcttaccatattcaccaaagacccatgaagtccggatgatgtagtatttgctcattgtatttgcaacggcttcttcaccagctaattttgtgcgaccatattcattcttaggtgcagctggggtttcttctgtgtacatttgatcattcgtaccatcaaagacataatccgtactaatgtaaacaagcgttgcgccgattgcttcagcagcattggcaatgttttgcgttccaaccacgttcactttgtaattgattgacttgccaggttcttcttcagcagcatcgacagctgtataagcagcacagtgataaaccaattccggcttattcttttcgaagtaagttgtgactgccgctgaatcagtaatatctaactcagtagcatctgtccccacatattcgatttggttttcgtctaataaatgtcgtaattcggtccctaattgaccattagcaccagtgattaaaattttcataatttattattctccttcaaaaaagtaaatctatcaacctcttaatatttgaaatatacattaattatctcttgagagcgtaaaatatcttgtgtaaattgtgttgaaacagctttttaagtatatcatacaacttattgtctgtcaacaactatttttaattaattattacttagaagttatagctccgtaagcaacatataatatattatcacgataaggtttaaataacaagcgttttttaaaatcttttttatttcgtatcgctgagtcatcaaccatacgtccctcgtcgagacaacttttatatattaccaagattaaccggcgcggtcaagctttttattaaaaaagctttgaaaagttaccagcaacgtttcatcgttaccaataacccttcaaagctctacggtatccctattgtttaatgagtgattcaacatccaaaatcttatcaatccagttaccttgatagaagtcttcttcatgagtaacaaggagcacgccaccctcgaaggcttggattgcttttcgtagtgcattcttcgtatcatcatctaaatggttcgttggttcatctaatagaagaaagttgcttgatgttaatagtagttcggcaatcttcaccttcgattgttcgccaccactaagttgtttcaaaggcttaatcgcttcttcggcagttaaaccagtccgcgataaaacttggcgtagttccttttgtttctgatcagggtattcgccttgtagatactgtaatggcgttgccatattattcggccacttcaagtcttgtttaaagtaaccgaacttcaccgtactagcaatctcaaagtcaccatcgattgctggaatttctttaatgatcgttttaatcaacgttgatttcccaatcccattaaaacctttcaagaccaccttctgatcacgaccaattgaaaagttcaacgctggtagtaacgcgcgatcgtaaccaatctccaaatcattagtcgtcaatagaatctgactggccgttgcatgatatggaaagcggaagttagccttcacgcgattacttggtggcgtcaaaatatccatatgtgccaattgtttctcacgactcttggcaattgtcgaacgggagcccgctttatacttgcggatataagctttcgttttttcaatcttcttttgttggttctcataggcctttagataactagccttattctcttccttttgccggaaggcttgttgtagtgtgccggtatacttcgtaatcttaccgaattcgatatcggcgatacaggttgtcacccgttccaaaaagtcataatcatgggagattgtgataaaggcgccttcgaaatgattgagataatcactcagccaatcaatgtggttcgtgtccaaatagttcgttggttcatccagtaataacatatcgggctcttctaatagtagtttcgctaaaataatcttcgaacgttgccccccacttagttgtgatacatcatgatccatccctaatgcatcaatccccaagccagtggcgacttgcataacgcgtgtatcaatatcatagaagctttttgcctctaatagttcttgaatcgcacccgctttttcgagcaattggtcatcaaggctctctgcgtagtccgcataatattgactcattaatttttctttcttatataaatccgcaaaagccgtcttcaaaaattcaaagatcgataatcctggtgctaacttcgcatactgatcgagataaccaatcttaagattcttttgccacgtcactttcccttcatccggaagaatgacgcccgtgaggatattgattaacgtactcttgcccaccccgttttggccggtaatccccatatgttcgcctttattcacttgaaacccggcgtcgtcataaagttgtttatctaaaaactgttgtgttaggccttcgacttttaaaatactcattgttttattcctactttctttccaaataaaaaacaggggcagcatccgctacccctgtcatgattacaatcattgactatcgaccactccatccatagtcactacccaaataaaccactgtcaccagtcgttaaatccagtaatgtcctatagatgacttttaatcaatattaggctctgcacgatgcgtcatcttcaaatgtacagagcgaagcttcataattaatggtcgttcaattaacatgtaatcgcacccttcaataagttagtcctatcctaacatagaacaatcgttcatgcaaaagccttagctaacccgtgcacgcaacttcgctaacagctgtgcgcgtttgcgccgagaaatgattagacgcaattcaccgcggacaattggataatccttagccctaccatgcatcattgtcgctaagtcttggcttgttaatccttgattagccacttcaattttgatcatttctgctaaatacgtactatagaatgcattaaacccaacatataagcctagtactgcactgattagaatcgcaagccataaattgaaattcaaaatcgtctttaaaactaacatgccacaaataaacgcaatgaccgtggccactatccctaatatgattgtatgtcttggggcgtctttcatctgctccaccttcttaataatgattaatcgtttatatttcatttatattatacctaattttagccgcaataagcagtaaaatcacttaattcttcaaattaaaaaccgctaacgtcaagcgagacagtcaaccacgtttactagaatgagaggctatgtattgtaaaaattgtgtatatattgtaaatttttctgtttttatccccgtaaacagtctagaattgtagtagtgcttttttgaataatataactatattaagaaggataattgaatctatatgaaaaacattgctttgaacatccgagattttttcttagatgacaaactactcttagccgctgccatcgcagccattgtcacctcatttttcaaccgcccacaacttagttacgttaatttccacgtgatcgtcagcgtcttttgtattatgacgctcgttcaagtttatcaacggctccacgtgcttgattacttcgctcgcgagttaattatcaaaagccgttccaaacgagccttgatgcagatgttattagcactaacgtttgtcggcgcgatgttcttaaccaacgatatgacggtattaacgttcgtcccgttattcatcttaattgcgcgtcaacttgaattttcaccaatcttaccggtgacgctcatcacgatttcggctaacctcggttcttcattaacaccgtttgggagcccgcataatattttccttgtttcgttttaccatatgacgattcgccatttcttcgaatattcaattcccgtcttgattgtcagcgtcattatgttggcagcaacgaccttcctctttccaaaagaacccatcaaacttcacgggttacatcccgttgaagttgaaaaagggccactgtggtatttcgttccattaacggttgtcgttttcctcgcagtgttctcattaattccattatgggtgacaccaattctagtgattatcgcgattctagcgtttgatcctaagttattcaaaacagtcgattacggcttattactcacattcttctgtttcttcatcgctgttgggaatttaagtcacatcccaacgattgccacattcatgcgatcaattgtcggaacagcaaaacaaacttacatcaccgggattatcagttgtcaattgattgcaaatgtcccaactgaaattttactttcaagcttcactaaccacagccacgcaatgttcttagccatcaatatcggtggggtcggcacaatgtttgcctcacttgcaaacttgattgcttacaaacgatttaagaaaggctggggcaaagaccttggtaagttccttgtcgttttcactggcatgaacttcttattcttaatcattttaggggtattcggctattttctcatctaattcttaaaaacagggcaactatctttacgatagttgccctgttttttgtcattttaacagtaatcgtcatgatagcattcccattcgcgtcttactgccgatcaacgccatcgtgacgccctttaattaagctcctaaattttacaaacatatgactaacatgacaaattaccccatttctgtaaagaaactgctatttaattgacatgcagcattgatatactctcctagttccaaaacttacctaggagtgacgctttattatcaaaaacaaaccattcttgttagctatcggccttatattgctgatgctaattacaacgaatatcgcgcgtgccgcattaaccaatgaagcagcaccagaaacgaaccaccctgtccaaaaactgatgtcatctaaagccattgaacaattcacggggcaacctgcccaagcagctgaaacgtcactggtcaaacacgcaactgttctaccaacagacaaacccgttagctgtccgattcatccagatcctgattccgcagaaattaaggaaccaacgcccgcccctgagccagaaccagttgcggccccagcacctgccgaaccaaccttaattgacaaagggacattcaaattaaccttttacgatcccgcggtccttggcgcaacaagtatgcccggtggaatgtacgccggagtcgctgcgcacttgggcgttatcccccgcggctcacaaatcaagatcacattaagtaccggtgaagtatggtaccgtgttgtcaacgataccggaaccttcgccgcttctaactcacaacaattagacgtcgcaatgccaaattgtgacatcccctctgccggtgtcttaaatgccaacgtgcagattgtccaacctgcttaattcaaaaaaagccaaccattcagatattacctggatgattggctttttttgatgttcaatttagaaataatcccataacatcggtttcgtatgactaaacgcagcactgagttgagcgatttgccgcggtgtcccttgcacatgcccaaagtgtgcttgactctcaagtgtgcgataccccaacatcgccttagttagattttgaatcgtaacggtgatgtctgcggtccccgttgctaattttgtcacagcagcttgtcctgcatgaatacttaactgccataagccggcattttcaggtaagaaatcatcttgaaccgcaatcgttaccgcagatagttccgctacttgataggcataacgcgcgaagaaatcagctagtgacacaatccgtgccatcatataagggacggttgtcgtctttacgattgtgggatcaggcaataaatcagctagcgactcagtcagtgcactctcatactgaattatcgcataagctgactgatgcttaagaataaagctcaatagctgttcttgacttgcaactgtcgaggtcatcagttcttgaatcacaaacgtctctggttggcgcgtataaatcatataccccgcgacccgtcctgtatcttctcgatagaccgccacttcccaatcactatgcttcataacatcatattgccaccaccaatcagtccgctgcacaccaccgacttgattgtccggatgctgattgaagaacgcatcaatcaacggcaccgcttgcgccaatgtcatccgtactacttgtcctgcactcggtgcaaatttcaatcgtggtaagtcagccgtttgaatttcaaagtgcgtctgatcaaaagtttgttcatagccaaaccgacgatagaagccgtatgaaaatggcgcgagatacgaaagcgtcacaccttctgcacgcatgtgttcaaacgcgagttgcatcaatgctgcaatcccacctttgcccgcaaactcggggtaactcgcgacataaccaataccactcatcttaaatgtctgcccattgaaccgtacgtcaaacggcgtcgctaataagccacttgccaaccggccgtcatcaaaaacgccaaaccctgcactatgtgtatacaactgtttgaagaattcttggcgcttagcactatccggtttattaaacgcatattgtgctaattcataaaatgctggttcatctgtttcaattaactttcttttttcaaccactgcacattcctcctgccatcacttatctttcactataagtgagcgagcaacaagatgcaatcgccacctttgtgattggaccgctttttgcgcataaaaaaaacgaccttttcttgggagtggtcgtttttttatagggagaaatctatgggtattagggagttatttcgttaacgaaattgcacgaagttgttgtgaattcactagaattcgttgcatcaactcgtgaaccgtaaaacaatcagttggtgcatagttcaagattaagatatgcacagtttcttcacatttctcaatgaccttaccgatatacgtcgcagacataatttcgtttgattggccgcgaactaaatcacctacttgaatcgccatgtccagttcacctcgttaatttatttaaccatgacctcattataacgaaaccgctttataaaatcaactatttacttatcgtcataattagcggatgtttatgattagttaatcagcttacctatttttgaatcttgcgatagtcagcatcgaaataccggccttcttgaatatctttaatcataccttcataaggtgcttcgctaattacgtcttcgttattttgtcctgcatcacccatataagtgattgtggcaaattcaggcactaacatcttaggatatgtttcatatttttcacgtgattcttccatgagtgcaatgtgatcattttggtaggtcactgtgatttctggatgttcttcaacccatttagggaagaaaatcatgccgtgtaacttgttttcgtttggcatgaagtccaacgcaacatcagtcccagttggttctgtccaagtaatcttgaagacgccgtccgttaacttaacgatgttggcttcttgatcacgaacccaacgacctgcaaccatcccaccatgaattcggtagtcaactgtgtggtcgttctttgcataccattcatactcccaaccattatcgtaagtgtaaatgaaatgcgttcctaagaaatcttctaattctttaaattgttttgtccttttaaaagccttcatataatgtaattaaatacatgtttttattaacgtgataagtgtactgctcaatcctttttttgtcaactttaaaaaagggcaaaaaaaatcgccagcaaatagctgacgatttttcttaattgatttcagttgctaattggcgtttcaccgcgtgtttaagaatcagcggtgccaaaacagtggtaatgataatcacgaaaataatctctgagtaataaagttcactcaacaatttagcgttgtacccaatctgcgcgataattaacgccatctcgccccgcgaaatcattgccgcaccaattgtataggctccttgtggcgaattattcatccaacgcgcaccgagaccacttccaattaacttcgagaaaacagctaacacggttaaaatcgtaataaatagaatatgttgattcaagcttgctaagttcatcgataaaccgatgctgacaaagaataccggaataaatacggtatacccaatcggttcaatatggcgattaatctcttccttatacggggtttgcgaaatcgcaatccctgcgaaaaacgcgcccactaccgcactcaattcaacggcctcagcgaaccaaacaaatccaaaacaaatgattaacgatgtaatggcgctcgcatatggtactaacgaacgacgactcaaatgcataacaaatggcacaatccatttcacactaaagtagaccgcaaccatgaataaagcttgcagcaataaactcaaccccaagctcatgtgggttgaactagctgcagccagttgcgccccaaaaagactggtcaagacactcaagataattacggccagtaagtcatccactaccgcagcacctagtataatcgtcccttctttactttctaacacgtttaattcacgtaaaacttcgactgaaattgatactgaggtggctgcaaaaatcaccccgatgaataaactctcaagttgactaataccaaaggccaagctcatcccatacatactgatcatcgggacaatcacccctaagacggcgaccactaaacttggtttgaaatacttcttcaacaaggtcaggttactctccaagccagcgatgaacatcaataacacgacaccgatttcggaaaacgtgtggataaaagaattttcatgtaagacaccgaacaacgcgggtccaagaataatccctaccaggagttgcccaatcacagccggcattccaatccgtttgctcatgtgtcctgccaataaagtacttattaaaataattgctaaagttgccattgattcatttccctccataaaaaagcacgccaaaattcccttctaccaccctaaagaaggaaatcttgaacgcgcaatgcttcaaccgattttttaacttatgtaataatattaccacaaagccacactggacgcaaagtttagacgttgaattggtaatagtattcattagattgacatcgctactttttcatgataattttagagtaataactaactagaggtgagtatttttggatgacggctcggacgaggcgttttgtttaattcatcagattattccttattatcggcaagaataacgatcacgaacgaccgcattttgactttcgataattaaaaggagcttaccatgactaaaacacacgcttatcaacaaacattagacgaactgcaacccaattatgcccaccaagattttgaacaggggctttcgcaaacagaagcggctaaccgcttagcaaccaatggtccgaataaactcgagagccatcacaccccgaagtggcaacttttcgtgcgccaattcaacaacttaatcatctacatcctaatcgtcgcagccctgttaacactcatgatgggtcactattcggatgccatcatcatcggtctagtagtcatcattaatgccatcattggttattatcaagaagcgaacgcatctgatgctttggaacgaatcaaagaaatgttggcaaccgaagcaaccgtttatcgtgacggtcagcggatcgacatcccaactgaagacttagtggttggcgacgttatcttcctagaagctggcgatagtgtaccagcggatttacgaatcgttgatgccgataatctgcgtattcaagagtcagccttaaccggggaagcagactcagttgaaaaaattgcaacacgcttaaccgaagaagaagttgctcttgccgatcaagtcaacatggcctttgcctccacttccgtcactaacgggagcggcttaggcgtggtcgtcgcaaccgccgctgataccgaaatcgggcaaatctcagttgctgtcaccgaaacgaaaacccgcccaaccccattgactcgcgaaatcaacggcttagggaccggcgtttcatttgtcgtcatcggtgcggccgtctttttattcctcttcggcttacttggcgaacattactcactctcagtattagcaatcgcgattgtcacgatggtggtcggttcaattcctgaaggattacccgcaacaatgtccgtaatcctcgcaatgggggtcagcgacatggccaagcacaaacacgccatcgtcaagagcttacctgccgtcgaaacgttgggctccgtcgacgtgattgcgaccgacaaaacggggacgctaactaaaaacgaaatgaccgtgaccgaaattatcaccgccgaaacgacttaccaagtcagcgggaatggctatgcgcccgaaggtcagattttattaaatgaccaacctgctgaattggataccaccctcacacaattcttagaggctagttatgaagccaatgatacgacgctttatcaagccgacaatggttggaccattaacggtgaaccaactgacggtgcctttttaaccttatatcataaggttcatggtatcgacgacttaccaacaaatacagaaattgacatgttacctttcgattcggattaccgctacattgctaaactcgtgcaactaactgatggtacgcaccgaatctatatcaaagggtctccagataaattattcccaatggcccaacaggcaatggtcgatttcccaatcgatgactggaatgccgatgtgacccgtttatcagaacaaggcaaacgggttgtggcggtcggttatctcgacgtgccaacaacgactgctacaattacccatgaacaactccaacaagggattcaactcttaggggttgccgggattatcgatccgccacgcgatgaagtcattcaagcgctcgccgaaatgaacgctgctggggtcgatgtcaagatgattaccggtgaccatccactgacggctaaagcaattggtgaaaagttaggcttagcaccaacgattaatgcgattaccgggccggaatgggatcgcttgtcggacgctgaaaaaccaaaagccgctttagaacaccaagtctttgcccgcaccacaccacataacaaactcgaaattgtcgaagccttacaagccagtcacaaagtcaccgcaatgaccggtgacggtgtcaatgatgcgcccgcattgaagcgcgctgacatcggggttgccatgggaattaaaggaaccgatgttgccaaagattccgcggatatgattttaaccaacgataacttcgcaacaatgtccgtcgcaattcgtgaaggccgccggatttacgataacatcaaaaagagtattctcttcttactcccgacttccttcgcggaaggcttaatcatcgccttcacgattttgatgcaacaagatatgccgttgcaagcgacgcagttactctggattaacatggtctcggcgattacgattcaattcgccttcatcttcgaaccagctgaagatggcttaatgacccgcaagccacgtaagaccggccaagcgctgatgaataaacacgatgttttccaaatggcatatgtttccgtcttgatggccttaatcggcttgttagcctacgattggttactcggccgcggtgtcgatcaagtcacagccagcacaatgatggtcaatatcattgtcatcagcaagattttctacttgttcaatattcggactgcgaaactcgccttttcaaaagctttcttcaccaaccaaaaggcattcggcattatcgcactgatgattattctccaattgatcctgacctacgtgccattcatgcaacaaaccttctacaccgaaccgcttaccttattagaatggggcgtttcgatcggcgcaggcttcttgattctaatcatcacggaattcgataagattatccgtttaatctgggcaaaaagaaaggcatagtaaaagagcgttcttctcgataggatgagagaaatgctcttttttgatgtgcttttcgaaactggcttttccggttaactacaaaatgtgacttatgaccaaacccgtcataagtcacatttttaggttaatcctcaaagtcgacccgcttcaaacgcactctaaacgtgcttcggcaagcatatttctgtacttaaccaaattcgcccaatcggcgattacatcgccaattgggtgaatccagttaatgctcaaaatataaccgcttgcctacgcactctataatctactaattacttcttctacattcttaatctccaccgacattgtgccgtctgggtggttgatgaattcaaatagatttgggttttggtagacgtcgattgggacgattagttcgatgccgtttgagagtttgagtttttgtttgccgtatttcttttcggcgatttcgcggacggctggtgagattggcgctggttctgctggcgcgttttccgtcatttctgctttaaactcactttgggctgaaacgttgtctttaaaaatcttcgccgccatctggctcgtatcgatttctccattggtttcaatcgtgtcgtagatcgcttctttgacgttggcgaccacatcgtgtttggcaacttcgaatttcttgccgattttttcagcggcttttttaacaaccttgacgttttcttctagcgatggcgctggttcgctttcaatcacgttcgttgataagtaggtcatcttttcaccggagaaggtgtacttcttctccatcaattcaaagccaaacgtctggaggttaatcgcaaacccttcgtccgccttttgcgttttattcgatagaatcgattggtgaataatcagttgattcatcaatggtccctcttcagcattgacataatgggtgaaggcttgatgataatcgaccttcaaaaaagccaagtaagcttgcgcatcttgttcatacaagacaacaaacgcatccgcactcggtgcatcgtcacttttttgatagaccgtgtaccatttttcaacgaggcgttggctagcgccgataaaatcagctgtcgcatcgcgcagaaaagatgcgagctcagcatcttggcgcagcacgccggtcttactctgggcagacgataatttcttaatcttgttggtcaaatagtcgcgtgtgttcccattggtaagatctagcacctgttgtgagtaaattggatcgccgagttcgcggtcgaccacttgtaaaattgcttgtttcaaataaatatccattagttaacatcccatctgtctagcgtgtaaagtattgagcgccttcaatcgtgtggaagaaaatcaccgtttcgaccatctcattgttgacgcttttcaaaaatggccattcgccttgtaacacacggagtgccgtgcgcggccgtgataattcccgttcaaaattggtctgtacctgaacgggggtgtctttaaaaatgtgcgcatcgtataaatagcgcgcatatgccgcaaaaatttgttgggcctgttccgttttaatcgcggcatacacttcacggagtgtctgcagtccatatgtcatcagacttgccaacatcaacgacccatttctagtctcaacacgtttcaaatagcgaattagattgccccagaactggctatacgcctgaatctcatcttttcggagatatggtgctacgtcagtcacaaacgggtaatgccaatttttagcattcaaataacgcgccgtcccaatgtagaacgtatacggaaagtcaaaatagatccgcgttaaatctttaatgaaccattcattttcaattgtagcgtaattatgtcccaaaatcgcgtggacttgcattgctacagctggatcttgcgtattgttgtgcttagtcaatgcgaataattgttgccattttgaagcggataaaagatccggccgataatgttttatttgttttaactgaaccggtgcagcattcaaggtatagccaccatcaaacggttcatccaataattggaccgtctgcacaaaatgccctccgagtgagtgacccagtccatagatgattgttgccggattaattcggcgcacccgccggaccacataccgcgtaaaccgccgtgcgagttggagttgctcatcattttcggtgttgccaatcagcatcgcatcaatattatacttccaatcttgataactctcacggacataattatccagccgctgcgtaaacgacttaatccgcggatcatccatcgtcccctcagtccccttgtaggaaatgtaggtatacgattggcgattaagcgtgacgtaataggcaactgccgaaaaaccagtttgttccgcattcggcaaaaccgttcgcgcgtcatagtgaatcaccgcttccgccgcttgatgcgcgtgaataaacacgaggtacttcacgtaatattgcaattcctgcacgttaaaatactgatctaaataattaagggccatcatgtccattttaaaagcgcggctatcaaacggatcggccagtatcggtcctggcttactcgtggccgccactttatcaggggctacatggtataaataggcgagcgcctgcttcgtcagtaccgtactctcattgattttttcattttgtaaattgataatcagttgtttcaaacgattaatcttgcgttggcggttaaattgcggatttgcttgaacggctgccaaactcgccacatccaatgcctgcagtcgccgtaacttggtccacaaatagggatcggctcccgccgtcgccaataattgatttaatagttttgttttacttgttttaagttgttgatagctgaattctagtcggttattgcgccgtaataaggcctgcgattgcgcacggtcaaacgtcaacggcacatctaaatgcgctttgaacaataacttacccatgtcatcgaagacttttgccaaccgaaagagcgttgagatgatcactgtcgtttccatttgcatcattccttatttttgtaatacttctattataaagtatctgactcaaaaaagctgagacgaaatcgtcccagcttagatggttttcggtttgatgcgcacgcctggttcaaacatgctttttggtcgcaacaacttccgcttaagctaaaatcaccagtaattccaaaaacggattactggtgattttgtcttaatgctcatttgctaaccgcgaccaaacgcactctgttcttaaacgtgcttcagcaggcatatttctgtggctaaccaaatttgccaaattagcgattgcgtcgccaattcggcaaatccagttaatcctaaaaatacgaacgcctgcttacgcactctgttctatgcagtaatttttttgtccacagcttggacacactagttgtcttgtctttggcgtgtgacgggcaaaaaacattttacttaggcgtggtttgaagaccgtcttgcaattgggacatagatagacagtttcttgatagtagaatgttgtcacataaatggccatcgcaatgatgaccggtatccaaatccacattggccaccaaattccacttagaaacccaagaattaataagccaatttccacaccatcaatcaataagccccacatcagcattcgccgatgtaatctttttaactgtgttgttttagccattgcgtcttctatgtcgctgattgtcatttcaaaaggcaccgcgctagtattttgaatcgattgcagtacaaattgcaacgctgctttctggttagctaagtctgtttcttttaaggctaactgattgagttgttgttcgactaacaatgccagtgtatccgtcgaagcttgactcgccatcactttttgaattgccttcagtgaaaagcccagctgcttgtagcctagaatgacttttaacgtctgcacttgtgcatccccatacagccgtcgtccattttcagttaagcttgccggcttcaacaaatcggcctgatcgtagtattgcaccgtccgcaccgaaacattacataatttagcgagttcacctgttgtatattgcgtcatagaatatcacctccatgccttgatactagctgatgacgtaacgtcacaagcaagtaaaaaagcattatttgctaaaacttttattcgttctcctttaatgcaccaatcatatcaatcccttttaacttgcggtgggtcatccccatcacaatcagtgaaaatagcaccgtcatccctgccgcaatcatgtagccgctagctggaataatgagtggaaaggccacttgttctgacgaggccatcgtgatgatgaaccaagtcaacaatttaccgattccaaagccaagcacaatcccaacaacggtgaagattacattttctcgcacaatataggccgtcacttctttgtcgaaaaagcccaggactttaatcgttgccaattcacgttcccgctctgaaacgttgatgctagtaaggttgaataagacgacaaacgctaaaaccgctgataacccgatgaaaataaaaacgattgggtctaaattagcactagccgttgcttgcttagccccttgatcactgataaacgttgtggccgccacttccgttgtttgttgcaaacgagtcgccaactgtttttcttgcttggtagtcatcttagcggtgcgcacgagataggcattagccgcaactggttgttgtagcgtttttgaaagagcagattggcggagatagacgctgttaccaaggtagttttcactgatacccgcaacctgaattcgtgcacgctgaccttgtgccgtttgcaacgttaaccaatcgcctttttggacagcatatgttttagcgaggttcgcagcaataatcgcaccgtgtttcggcaatgtgagtcgttgttgttctcgcggtgtttgcaaagcgacgtactgtgcaatttttgcttgatcagcgaccgcatagactgtcgtcgcttgatccgtaatccctttttgcttgaacttaacttgggtcattgtgaccggtaagtaagaccgaaccttctcagtctgtgttaaaatcgacttcgtttgggctgtactattcggtattttaagcgtcacaattgcttggtaatgggtcaattgcttaaactgacggtcagcaacttcgccaattgacgtctttaaaccaaagcctgcaaccattaaaccggtacacccagcgatgcctaagatggtcagaatcatccgtgctttatagcgaaaaagattacgataagttactttttgatggaaactcaatcgccgccagagcagtgtgattctttctaaccaaatccgttggcctggtttcggcgcttttggtcggagtaattgggtgggcttctcgcgtaaatcgcggattaaaacataccccgtggccccaactgtcgcaatcaagaccgctccaatggctaataaaattggagctgtccaaaaatgggttggataatgcgcaaaggtgtagaccggtttttggattcgatagacgactagcggtaataacttcgtgcccaaaatggtgccaagcacggtgccgatactacctgttagtagcgcatatagtaaatacttctgcgcaatttcccaattacgatagcctagtgccttcaatgtcccgatttccttgcgattttcttcgatcattcgcgtaatggttgtaaaggtaattagaatcccgattaagaaaaagaagacaggaaagacattccctatcgcatcgatgcgatccgacaagctcgtaaattcattaaaacccggattagcactgcgcgcagttaataagtactgttgctgtggctgagttgtgtgtgcttttaattggcgcatgagctgtgtttctttagtcgcaatgccggtgcgataagcctgtgaaaagctactgtggcgatccaaatcactaaagcgcaccatcatcaccgaatacggttgaggtgcaaatgccttttgtggcaaatacataaagccatctagctgaccatccccgactggcacggttccacgttcctgacggtcgatatataacggtgagtccacataaccgaccactttaaaccgatgcgtcaatagctgctgactcttaatcgtcaccctctgccccagacgataatgcgtcttaaccgcgttatccactaaaatttcattcgttcgttgcggatagcgcccggtagtcagcgttaagcgattttgccgtgcagttggttggtaattatataattgtaagttaacatcccgcgcttcatcgcgatacggaatccgataacccaattcagcttggacaccatgcatttttccgaccaccgcacggtcctgttccgttaagccagcggtcccactaatctgtaaatcggatacgcgttgcgtggtgacaaaatgatccacagtctcttctaagttcgggccaatcgatttaatccccacaaacaataagacacccattaaaataatcaggataatcgcaatgaaccgtccaatcgcctgccgaatatcgcggaatgtggtttgtaaatataaacgtgtctgcatattagccacctaccattcaatcttttcaactggaagtgggttgggattcacatcaattgagcggacgcgcgcatcgttaatgtgaatcacgcgatcagccatctgggcaatcgcggcattatgcgtaatcaaaacaacggtccggtgctgctgccgactaacttcttgtaataatttaagaatctgcttgcccgtttcataatcgagtgcgccagttggttcatcacacaagaggagcttcggattcttagcaagcgcccgcgcaatcgccacccgttgttgctccccaccggatagttgggccggaaaattctgaagccgatcctgcagaccaacttgttgcaaaacaagcgcaacatctaaggcattcggcgagacagccgttgccagcgccacattttcttgcgtcgttaaattcggcactaaattgtaaaattggaacacaaacccgacatcagtccggcgaaacgccgtcaattggcgcgcactaaactgcgcaatatcgacaccatcaatcaacacttgcccttcattgactgtaaaactaatatcacgattggccacgattgttgtctcgcccatctgataccgcttggctacatgtcgtacatcaattaaactcataacgatcactcctatacctatttaaccggttacatttgactagttttattatcgcatatccgagcttgcacgacacaaaaaaaagacaatcagaaaactgattgtcctttaagataagtaccatttttcttaattcaacgtaaaaccctgttttttcaaaaaactcgccactgctggtcgtcgcacttcactaaagaaggccgtattcttggtcgaccaatcagtttgttgctgattggtcccacgattagcataataattttgcatttgttgatcgtattgcactaggttggttgcctgatgcacatcatattgattttgagcgacttgattaacttgcggcaatcgtggtttaacctgatttttagtcttcggaatcccgaccgttaacccaaatagtgggacggtataggcgggcaactcgagtagttcagcgacacgcgcaatgtcattgcgaatcccaccgatataacagatgcctaagtctaacgattcggcagcgactgccatgtcctctgctgcaatggctgtgtcgaccgttgcgactaataaggcttccatattttgaatgccagctactgactggcccgctttttctaagagtgtggcttgtcggtataagtccgcgacaaaaacatagaacgtccccgtctgtttaacatacgccgcactttgagaaatcgttgcgatttcatcacgaattacgggatcggtcacttcaatgattgaaaatgcctgaacgaaattcgaagaagacccactttgagctgccccaatgagttgttgtttcactgtcgtgctgaggggtgttggctcgaaatcacgaactgaaacatggtgttgcatttgttcgattaaagatgacatacaaagactccattcgatttaaaataagttgcttctagcatagcgcgttaacacaaaaagggctggcgcaaaattgccctagccctaaaacgtgcttttcaaaagcatactgctgcgtttagctacacaaggcgaattctcgcagtataaccgcttttgacgcactcttgttgaaacgtgctttttggttgcaacaacttccgcttaagctaaaatccgcagtactcctaaaacctggattactgcggattttgtcttaatgctcagttgctaaccgcaaccaaacgcactctttaccagtggatttcgttaaaaatctttggccctttgcgcatctttgtccgatcatttttagcaacgtcggtctgttttgatctgccgccaccttttttctgatcaattagtgcttgcattttttctttttgcgttaattttggtgtttgtttttcactcatcttctgactcctaacttttctacattctataagattagcatagaattcaaagaatgcctaaccgttattttgtagggccggaatcaagcgcttcgtcacttctcgtacagaaaacgggttttgccccgtaatcaactgaccatcctggacagcaaatggtttgtaaaaccgttttcgcacaaattgcgcgccgttttgagttaccacttcttggtttaaaaatggcaccacttttttcttgcccgcaataatttcttctgcagtggtaaacccagtcacttttttaccagcaatcagatactgcccgtcatcatttttaatgcgtagtaaacccgcgatcccgtgacaaacggacgcaagatagccaccgtgattataaatttcccgggcaattgtttgtaattctggattatcaggaaaatcccacatcacaccatggccgcccgtatagtaaatcgcagcgtagtcagctggattgacatcgcttggcttcagcgttgcgactaacccccgttgcacgtaatccggttgttcatagatggtcagaattgattcatccgtgtacttcatcccccgtggatcaagcgggacaaagccgcctttagggctgacaaaatcgtaatcaatccccgctttttgcaattcatcaacgaactctgcggattcccccagccataatccggttggatcggtggttccttgataacgcgtaacattcgtgtggacaattagtactttgggcatctggctagcctcctaaaatttagtgatgtgggtttattaaatcatttcgttcttattctgtcaattgaaaaataactacttacgccgtaacaatccaaatagcgttctgaattgatttttaaatgaaacaacatcattgaagatgtcctcgccgtcgttcaacatcttgaccgttaaccagccgagcgcttcggtaatcgacatcgcaacggtcgcattgactgcagccccggttactgtcccaacaactggcactaattttaaaatgttaccgactgcactccgacctaggccaacgaggaccaattctttcgacaggctcttgcctaaactagccgaccaagattgaccgaatagtttatgcaaacgcgccatcatcgttaattgaaccggcaccaacaagaacgcatcggaaaatggaattggtgaacagccaataatcgctgctgttagtgatgctgcgtgaatgatattgtgtgcctttttacgcatctgatcatccacaccgactaggaagtcttcaaagaccccatcaaactgtgtccgactcttcgccatcgtcttttccgccaatgctttggactggttaaaagacttcgcaatcacagctgccgattgttgcggcaacttctttaagacttccgcaaagaaggaatcaaattccggatttggttcaccattcacttgttgcttattaaaaggtttcttcatcatgccacgctccttatctgattgactaacatcgctactttaaagcgattatataatattgaacaacagttagtctatcgagcgaaaggctgactttttaaagaatctcctgaaccccttcttcgatcgtcgtcaccttaaattccgggaaccgtttcttaaacttgtctgaactgaacaggttatcttcttcatatctaggcaggagttcttttaattcctttagcggtttgctgaaccagctaccgaggttgaactgccacatttttaaaacagtgtagtcgattttctggtgggtcagtttgcctgctagcgcgatgatttcggcgtatgttttgccgtcatcacaaggcaggtgccacgtttggccaaaagcatctggcgtattgccaatcaacgccatcgcacgactagcatccggcgtccaaattaatgtccggaccgcttgattattcaatggcacacgcacctttttacccgccttgatattgttaaagaccatcgtgttcgtaatgctttgcgtcttgcctggaccgtaaaattcaggtgcacgacaaatgaccgcttcaattgcgccagttgccatcttatccagccacaactgcgccatctccgctcggacaaccgctttacggccaacgggttcaaaaggactcgcttctgtctggagcgtgctatttttcgcatacatataggtattatcgaaaaagacgagcttggccttgtgcgcgatgcacgcgttaatcacgttggtcatcataatgtgaaattgcgcttcccacatgtctgaattcattggtaagccggcggtaaaataaataatttcactgcctgcaaccgcacgatcagtttgggcggcatcgagtaagtttgccggaaataattggtcatctgtgttcacttttttcggattccggctgaccagtcgaatgtccgttgtgaagtccttatgaagtgccttggccaatctgaccgctactacctaagatcgtttgcattttaaaattctcctcttcattgttgtttttcgatgactgccgtaatctgatccagcagtgtttttagttgattgatttcgcccagttcgtgttgcaagtaataatagttcttcgtgccttcgcgtctaaagtcgaccaagttggcttccttcaacactttcaaatgatgcgacactgccgggcgcgacaagtccgacgccgccattaaatccgtgacttgtaagccatcacaagctttatcagccatcaattctaaaataatactctgccgcttctcatccccaagcgccgtcaaaaacgggctcagctcagcaaagctctgtttaataaccttcatttcatccatacattaatctccggttttattttattggctcataagtttaaaccattaaaccgttgatatgaatttttgtcaacaacttcaaatcaatgcaacaaaaaaagcctcactcattaactgaaaaatataatggtttctcaagtcggtatgtcacacaagcattcactaagttcgctaaggctgtcattgaccgttatggtggacaagtcaaatattggctaagctttaatgaacaaaatggttttttctttgaacctggctttgataatactggctttatcaatggtgaacgcgacttattaaccctttatacgatcgctaataatacaatggttgcgcatgctgaaatcgccaattacttacacgcccactaccctaatgaccaaattggtgggatgttagcctatcaagaattctatcctgcaaccagtcatccccaagatatctttgctgctagaaaagcatcagaatttatcaaccaacatttcgttgacgcctttacaaaaggtcactattcagccgaagtactgcaatatatgcaaaatcatgacttaatgagcagtattcagcctggtgatttagcgctcattgcaagtcatcacaacgacttcttagcgttcagttactactacactgtcgcactcgatcacacaaaattaacacccaacacaccacccaattattacatgcgcgatgcgagtgtccctaatccttatttagaaagtagcgaatggggctggcagattgatgccctcggttttagaaacgtcttaacaaaactttcgaatgaaactggcctccccatcttccccatcgaaaacgggattggcattcgcgaagaatcgctgaatcatgaaatgattcaagatgacgaacggattgcctatcaccgcgaccatatccaggctttgaaagacgcagttgatgaagacggcgctcacgttgtgggctatcttggttgggggttaatcgacatcccaagttcaaaaggtgatatgaataaacgctatggcgtcgtttatgtcaatcgaaccaatcacgacctcaaagaccttgctagaattccgaaggctagtttttattggctgcaaaaggtcattcaatctaacggtgaacaattagactaaaaaaagtgcgttaaaaggagtgttttctatgcttaaacaaggaagtcggcgacaaagatttattgatcagtttacaaatatcgcctttaaaatcgggaatcaagtgcatttgcgttcattacgtgatgccttcgcgattattatgccactattcatcctcgccggaattggggtgctcgtgaataacgttgtattcccctgggtccctccacggccaaatgctaaccaactttcaatacttcggcacttacattaccaatgggactttgaacgttgctgggctattactcgcacctacaatcggctactgtttagcgcgtaataagaattacgtcaacaaaatttccgcggctgtcatggcactagggactttaatcatcatgatgcctaatactgttccggtcacaccactagctgccaaaaaagccgtcgaagtttctggcgtcttaactttccaaaacgtgggaacaaccggaatgtttgccggcattattattggtttagtcgcaacagaactctttatgactctttcaaagcttaaaaaattacaaattaacttgagtgatgccgtcccatcagctgttgctggttccttcaacacaatgattccagccctcattacaatgagtctttttgcggcacttgctgcgattttaacggctggtttccacactgatctcatcactttaattacaaatgtgattcaagaaccacttcggcgcgttaatacaagtttaccgggtctccttctgatttacgggactggtaatctcctcttctcatttgggatccatcaagctgtcattaacggtactttattggatccagtcttactaatcaacatgaacaaaaatatggcagcttacgcagctggtcaacacatcccttatatcatcaacaacgttttccgcgatacatttgggatgcttggtggtaccggtagtactatttgtttattgattgcgaccttgctcttctcaaaatcacgcgctagtcgtgatattacaaagctatcattcgtcccaagtttatttaacattaacgaacctgttattttcggttatccaattgtcttcaactttgcgctcatcattccatttgtcctaatgccaggacttggcatcagtattgcctacttcttcaccgcaattggctggatgaatcgagtggtcgtcatggtaccttggaccacaccaccattactcaactcatatttagcaaccggcggcgattggcgcgcccctgtgattcaaggcttcactttaatcctcggcgttctaatctactggccattcctgaagattagtgaacgcgttgcggccaaacaagctgaattaacgcaataattaaaaaagaattcggaattttcgttagaaaattttgaattcttttttgttttaccgatgatcttaacctcccctggtcttataaatccggattaggcgtaatcacttgcaacttatgttctaagagtcgcatctccaatggtgacttggcactcggatcaccatcaatgcgggtttgtgcactttgctgattgtcgactgtgatgctgatttcattcgctttaaagtaagtcatcccgggaatctttttaaaattacccgttaagaaataagggagaaacatcactgaccgtgctagcgacattttcggcgcaacgaagacatggaaataaccatcatcgggttgcgcttcgggattgaagttggtaaatccaccaacggaattcgtgagggtcaccagcaagaattgcgtgtctttttgccagtgccgatcaggcgtttcaatcgttagcggataatgctgatgctccgctaatgcatggatgcctttgcttaaaaaagctagcggcccccatttttgtttttcactctgagtcacgttcaacgcggcgtccgccaaaatgcccaatgtcattgtactaatcaagtaatcatcgttcacttggccgacgtcgagtgggcgcagttgaacctgctgcagattttcaatcgcttgatcaatgtccaacgggatttgtaacatccgcgccaaattattcacggtcccagcaggtacaatgcctaaataaggcggctgatctaacgtcgcaagaccactaacgacttcattaatggtcccatccccgccgacagcgaccaccacatcaaagcctgcccgcgccgcttttttagctaaccgcgttgcatctttcggcccttccgtcggcatcagttcgaccttgtgttgattcttgatgagtgcctgctcaattttctgaccaaccgactcaccattgttgtgcccagagtggggattataaataacggcataacgatacataaaaaagcctccttcaattactctaagcatagcaaaaatattgggaataggctgggatggcgcattaggcttacacttaaaaattccgatggtgtcaaaaacaaaaaaacaccccgcaatataaaattgcgaggtgcttgtaaacattgatataaaagtgatattaacgtttactgaattgtgaagctttacgagctttcttaagacctggtttcttacgttccttcatacgagggtcacgtgttaacatgccagcgctcttaagagctggacggaagtcagggtcaactgtcaatagggcacgtgaaataccgtgacggattgcaccagcttggcctgagaatccaccaccattaacgtttaccaagatatcatagctatctgttgtttcagtaattgttaaaggttgtttcatatctaaaatcaagttagcaaatggaatgtaatcaacaacgtctttgttgttgatagtgattttaccagtacctggtactaaacgtacacgagctactgagtttttacgacggcctgtaccgttataagttacttgagccactatagtttcctccttaaataatatccgtaatgtctaagacttctggattttgtgcttggtgtttgtgttcgccaccagcgtatacgtgtaacttcaagaattggttgtgacccaatgagttcttaggtaacatccctttaactgacatttcaattaaacgttctgggttgttttcacgaatttcgccagcagtccgagttttcaaaccaccaggatggttactatggtgatgatataacttgtcggttgctttgcgacctgttaatttaattttttcagcgttgatgacgatgatgttatcacctgtatcaacgttaggtgtaaatgttggtttatttttaccgcgtaagatagaagcgactacagttgatagacgacctaatgcaatatcagttgcatcgatcacataccatttacgttctacttcgcctggtttagccatgtaagttgtacgcacgatttattcctccaatattctgtgtttgtttgacactcaataagtttccggggcctatcgtggggcaaacaataccagatactatagtatcgtaatttcacgattaagtcaattgaatctcaattattttcatcagtttcgtaataaacttttttaaggtacaaaccgcttgctggcgcggttgagcgagcttgttgacggtccttaacttcatacagccgtaaaaaatcgtggacatcccgccgaccgttgccaatttctaataaagttccgactaagatccgcaccatgttatacaaaaagccgttcccataaaactcaaaaacgagttcattttcggattcattgaaaacaacggtcgcatcataaatcgtccgcaccttatccttaatgaccccacctgaagccgcaaaactagtataatcatgcgtgcccatcacatctggcaagcccgctttaatccgttccacatcgattggatacggataatgaccggtataacgtcgcttgaatggattcgtataatgcccaagatcgacccgatacatataccgtttaccgaccgttgaaaatcgtgcatgaaagtcatcatccgctaactgactatccacaacctccatatcaagcggtaagaggctgtttaaggcccgtaacatgctaatagcgggtaattgacctggatagtcgaaatggaccacctgccccgttgcatggacacctgcgtccgtccgtcctgaaccatacacttgaatataagcacccttactcatctttgtcagtgctttttctaatgtgccctgtactgttcgttggttcggttgcacttggaaacccgcaaaatccgttccatcataggcaattgttacgcgataccgttgtgtcattttatccctcttgtgttaaaaagttagtagttctattctaaataattttctgaaaagtagcaatctttttatgaatgttcgtaaaaaatttgatttaaaaatgcatttttaatataagacaagttcaaatgctgtataattattataagtagaaataaggagaattgtgcaatgaagttcggatacgcacgcgtttcatctgccggacaaagtctagcaacccagattagtcaattaaaggaagaaagctgtgacattatctacagcgaaaagtttaccggaactaccgttgatcgccccaaatttaatgaactattagatcgggtttcaagtggtgataccatcgttgttacaaaacttgatcgcttcgcaagaaataccaaagaagcacttgaaatcatccaataactttttaaagcccgcattaaaattcatattttgaacatgggcatcattgaagacaccccttccggacgactcatttttaccttatttagtgcttttgcgcaatttgagcgcgatatgattctcacccgtacccaggaagggaaacataatgctcgtgtcaccaaccctagttatacactgaaggtcgtaaaacgacctatactgatgatgacatacaagcagccctagacatgcgtgaagagggctttacgtacgctcaaattagttaccaaactggcattagtgcttcaacgttgaaacgtcggttcaaaaaaaacaagctaatcaaaaaagtgcaaaaaaaggactcaattaaatcaacctccgttggtttaactgagtcctttttgcgttatcttaagaataaaagtgcgacggttaaaaggcccaccgtgataaatgccacagtgtctcttgtccgccatttcaaaattcggtacttactgcggccttcgccaccttggtacccccgtgcttccattgccgttgctaaatcgtccgcgcggttaaaactgctgacaaataacggaattaaaatcggcacgattgctttcatttgttggaataaatttccttcaccaaaatcaaccccgcgcgcacgttgcgcatccataatcttagtggtttcatccatcaatgttggtacaaagcgcaatgcaattgatagcatcaatgcaacttcatacactggaaaatggactactttaagcggcttgagaattgattcaatcgcatccgctaacgacaatggcggcgtcgtcaatgtcaggagagtcgacatgaaaataatcaatacaaagcgcatgaagatgtaggcgccattaatcagcccatactgggtaagcgtcagaaatccccactgccaatagacatgaccaccacgggtgaagaaaatctgtaagagcactgtaaatagaattagccataacagcggcttaacccctttaataaagaagtcgagtttaatttttgaaatcccgattagtgctaacgtaaagaccagtaataaagcgtaggcttgccatgtacgcgctaaaaagatgatcccaatataataaaaactggctaataacttcgcccgtggatccatccggtgtaacacagaatcaccagggatatatcggcccagaattaatttattcatgtccaatccccgccttcttcggtagttgttccgctaataaggcggccaattcatgttcggttagtggtacttgatcaaagacaaagccttgtcgcattaaagcttgcgcgaactgagtcgttgttggtaagccaagttgtttttccgttaaccaatccggatccgcaaatatttcgcgcggtgccccggtcttagctagtttgccatgttccaaaacggtaacgttgtcggcgtagttcgccacatcatccatctgatgggtgaccatcacaatcgtcatcccctgctcactgtgtaacttttcaaaaagcgccatcatctcacggcggccaactggatcgagccccgcggttggttcatctaagaccaatacttccggtttcattgccaacacaccagcaatagcaacgcggcgcatttgcccaccagataaatcaaaaggtgacttgtcaatcacgttagcgggtaaaccgacgagttcaatcatctctttagcgcgttcaagtgcttcagcttcagggacaccgaagttctgcggaccaaaagcaatatctttttgcaccgtcgactcaaataattggctttcaggaaattgaaaaaccatcccaactttttgacgaacagcctttaagtttttgttgttggtctcaggcgtgatttcgcgctcaccaatctgaacaacgccgctcgttggttttaagagtgcattgaggtgttggagcaatgtcgacttgccactacctgtatgaccaatcaaagccgtataggagccacttggaatggtcacattgatattttctagcccaatcccttgaaaaggcgtgcctggctgataagtgtagcttacatttttgaatgtaatgtccataagtactcaaccatcctttccgttgtgagataatctgtgggcatctcgatagcgcgttcatttagcgctgctttaagtttttctggatatggaacatctagccctaaatcaagcaaacgttgcccatatgcaaaaatatcggccggtgtgccctgatcatgcacttgccccttatctaagataatgatccggtccgcacttgcggcttcgtcaatatcgtgggtaattgatagcacggtcatgtttgtttcttgttttaacttatgaatggttgcgagaacctcttcgcgcccttttggatctagcatactggtgacctcatcgagaatcagaatctcaggttgttgtgcgatgatccctgctaaggccactcgttgtttttggccacccgacaaacggcttggttcacgtttcaagtattcactcataccaacacgttcaaccgcgtctttaacccgttcaatcatttcagctcgcggaatcccctgattttcgagaccaaaagcaacatcgtcttcaaccgttgcaccgacaaattgattatccggattctgaaaaaccatgccaattctctggcgaatagtccacacgttatccaacgacaatggtaacccatcaatcgtcactgatcccgattgtaaatctaacaaaccgttcaatgatttcgcgaaggtactcttaccaccaccgttatgaccgataatggcgacccattcgccggcattgatactgacagaaagatcattcagtgctaaatgtccttcagattgtgggtattcatattttaaatgttcaacttgaattattttttgctcattcatgattaataacccgtattttccttggaattaaagtgcattggttatgttatccatgcacgtttcaaatcaaaaacctgttcctattttatcatataaaaggccatagcgctttcgttagtcaccctttattcaaaggatatccaacacaaaaaacgtctaactccgatttaactcggaattagacgttattttatgtaaatcatcaatcgatgaaagccatactgtgttgctagtatgaccttaggactagactcggagtacttccatcatcataacgccctgtctcatcgatcaaatgacctaaatcattttgtgattaaacaagttcaataatcaccattaatgcaccgtcaccacgacgaggggctgttttaagaatacgtgtgtaaccaccatttctttcagcataacgtggagcaatgtcactaaataatttttgtaaagcagattgaacgattacagcatcgtcttcttcgcgaatatcagctacttcgttacgaacgaatgctgcagcttgacgacgagcgtgtaaatcaccgcgtttacctaaagtgatcattttttcagttgttttacgaatttctttggcacgagcttctgtagtaatgatacgttcattgatgattaaatcagttgtcaaatcacgtaacattgccttacgttgtgagcttgtgcgacctaatttacgataactcatgaatggagtccctccttcttatcagtttattcttctgtgcgtaagcctaagccaagatcaaataacttgttcttaacttcttctaacgacttgcgaccaagatttctaactttcatcatatctgcttctgatttgtcagttaactcttgaacagtgttgattccagcgcgtttcaaacagttgtatgaacgaactgataaatctaactcttcaattgtcatttcaagcattttctctttatgtgtctcttctttttcgaccatgatttcagcatttttcgcttcatcagtaagatctacaaagattgccaaatgctctgtcataatcttcgcagctaagctaatagcttctctaggactgatggaaccgtttgtccaaacatcaagtgttaacttgtcgaaatcgttacgacgaccaacacgtgtactttctacttgatagttgacacgactgattggggtataaattgagtcgattggcaaaacaccaattggcatatcgtctgacttgttttgatcagcagcaacataaccacggccttttttaactgtcattcgcacgtggaaattgccgccttcagctactgtacaaatatattgatcagtatttaagacttcaacgtcatcatcagaaatgatatcagcagcagtaactgttgccggacccttaacatcgatttcaattgtcttgtcttcttcaacatgcaatttaagtgctaattttttaatattcaagatgatttgtgttacatcttctaggacgccatcaattgttgaaaattcatgtaaaacaccatcaatttgaatatctgtgacagcagtacctggtaaagaagcgagtaaaatacgacgtaaagagttacctaaagtcgtaccatagccacgttcaagtggttctacaacgaacttaccgtagttagtactttcatcaacctttgtaatgtttggtttttcaaattcgatcattcttatcttttacccctttcaaaacgagaagtgtttatacgtgaacacgtttcagtttgtctcaaaatgaagcgtagcccagactaaacacgacggcgttttggaggacgagatccattatgaggaactggtgtaacgtcacgaatagcagtaacttctaaaccagttgcttgtaatgagcgaattgcagcttcacggccagaacctggtcctttaacagcaacttcaacagatttcataccatgttccatggcttctttaccagcagcttctgcagccatttgagcagcaaaaggtgttgacttacgactacctttgaaacctaatgaaccagcagatgaccatgcaacagcattcccatgaggatcagtgatcatcacaagagtattgttaaatgttgagtgaatatgtgcaacgccggcttcgatatttttcttcacacgacgcttacgtggagcatttttcttgtttgccataaattataacctccttttactgattatttcttcttgcctgcaatcgtaactttcttacctttacgagtacgtgcgttgttcttcgtattttgaccacgaactggtaatccacgacgatgacgcatgccacgataagaaccgatttcttgtagacgtttgatgtttaagctaacttcacgacgaagatcgccttcaactttaactttgtcgattgctacacggatcttgtcttcttgatccggcgttaaatcacgagtacggacgtcttctgcgacgccagcatcagccaagactttaacggcagttgtatttccgataccgaaaatataagttaaagcaatcacaatttgtttatcacgtggtaaatccacacctgcgatacgtgccattcttgcacctcctgcttaattaatattaaccttgacgttgtttatgttttgggttagctgcgcagataatcataacgcggccttttcgtttgataactttacaatgttcgcacattggttttactgatggtcttactttcatatcgactgacctccttgatatgatccttacgcctatttaaagcgatacgtaattcgtcccttagtcaaatcatagggtgacaattcaactgtcacacggtctccaggtaaaatcttgatgtagttcttacggattttaccagaaacgtgtgccagaataactgcaccattttcaagttctactttaaacattgcatttggtaaagtatcagttactttaccttcaatttcaatgacgtcatcttttgccacgcaaaagtacccccttgtggttgtgaaaattcatacagaaaaatggtgagagctctccgcactcaccgctagtggtcataccgagatattatatcacaagtattaaatttttaaaagcactgagaattctgtcattaaacaactagtcaggcttttacgtgaacaatgaccgtgagatcacttgagttgatgactagtctttaatggtatcaagtactttttgaacggcagagaacacatcatcaatttcttgattcccatccaccgtgtaaagtaggttacgtttttcataataatcaagtaaaggtgtattcatttcgatattgacctttaagcgattcttaaccgtttcaggtttgtcgtcttctcgttggaagaaaacatgttcgccgcaacgatcacatgtaccttccactttagttggatggtaaagtttgtggtacgttgcaccacaatttttacaaataaagcggccagataaacgatcagccaagatttcaggatcaacatcaatgttaatcacaccatctaaaggtttgttcaatttatcagtaatggcagctaaagcatccgcctgatcaagagtccgaggaaaaccatcaaggagataacctacattagtatctgcttgtgcaagacgttcctcaacaattccgttggtcacatcatctggtaccaattcacctttatcgatgaatgacttagctttaaccccaagttctgtttgatctgccatagcagctctgaacatgtcaccagttgaaatgtgtggaatatgataagcgtcaacaatcttttcagcttgcgttcccttaccagcgccgggaagtcccattaacatgagattcatgcctttgcctcctatttaaaaccaggattcaatactttttaaacgataattgcttatcgaatgaatccaacatacttgcgtttcataagtaacccttcgagttgacgtgtgctttcaagcgcaacaccaacaacgattagtaaactcgtcccacccaaaccaattgattgaggtaagccaccgaggtttgctgctaattgtggtaataatgcaattaccccaaggaacaacgcaccgacagttgaaagacgcattaatacgctagaaagatacttctcggtacctttacctggccaaacacctgggatataactcccttgcttagtcaagttctccgcaactttttcagggttaacctgaacaaaagcatagaagaaggtaaagagaacaatgagcaccgtataaacaatcgaacctgtcacagtctgcatgctgaagatatctgataatactttaaaccaagtatctgcaccatgacctgattggaaggccattaagattgtttgaggtgtcataataaatgaactggcgaagataaccggaatcacaccagcgacgttaactttaaggggtaggtaactattttcacctgcaccagcttcacgacgcgtatattgaatcggaatctttcgatttgcttgttggacccatgtcacaaatgtgacaatcacgagtactgcaataatcaaaccgatgatgaataagacacctttccacatatcgccttttgaagcgttcaagacttgttcgcggaagatttggtaaagaccgcttggaaggcgtgcaatgatccctgcaaagatgatcattgacacaccattccctaagcctttatccgttatctgttcacccaaccatgtaattaacatcgtaccacccgttaaaatgatcccgatgctaacgaaggtcttaatccccggatctttaaccaagcccatttgactgagtgagttaaagccagcggtaatccctatcgattggataaacgctaagatgatggttaagtaacgcgttacttggttaagcttacgtcgcccaacttcaccttgcttgctccattcaacaaacttaggcacaatatccatttgtagtaattgaaccacaatttgggcagtaatgaatggtgaaacccccatcgagaagatggaatagttcgccaagccaccaccacttacggtatcaagcaatgggatcaaaccagttgaacccaacttagtcaatgcaccagcattcacacctggtaccgtaatttgtgcacctaaacgataaacgatcaaaacgcctaaagtaaacaaaatcttactacggatttcctttactttaaatgcgtttttgagtgtctttagcaattaaatcacctcaattgaaccgccagcagcttctacagcagcttttgcagcttcagaatacttgcttaccttaatgttcaattttttgtttaattcaccattcgctaataatttaacacctgataattcattcttaacaacgcctgcttcgattaaaacagttgaagtaatttctgcaccgtcttcaaaacgatttaaatcgtttaagttgacaacagcatattccttacggttgatattcttgaatccacgttttggcatacgacggaataaaggcatttgtccaccttcaaatcctaaacgtactttactacgagctttttggcctttttgaccacgaccagcagttttaccagtacctgaagaagtaccacggccgacacgtttacgaacgtcacgagcaccttcgttaggtttcatttcatgtaatttcattattgtgcgcacctccttgcaatatatgttgaaattagtctttaatttcttcgactgttactaaatgtgcgagtttgaaaatcacaccgcgagttgcagcatcatctggtttgattacagaactatttactcggttcaagccaaattctttgaccattttacgttgttctggaagacgatgagcagcactttttcttaaagtaatctttaatttagccatgttcagttatcctcctagttttgtaagctttctacagatacattacgtaattctgcaatttcttcagcagtcttcatacgagttaaaccgtcaattgtggcacggataacattgatagcagttttgctacctaatgttttacttgtcacatcatcgattcctgctaattccatgacggcacgaacagcaccaccggcagcaataccagaaccttcaacagctggttttaatagaacacgaccagcgccgaagcgaccaataatttcatgaggtaatgttgttccgaccttaggaacattgataagattctttttagcgtcttcaacggctttacggatagcttcaggaacttcttgtgctttacctgtcccgaaacctacgtgaccgtctttatcaccaacgattacgattgctgcgaaacgtagacgacgtccacctttaacaacttttgtaacacggttgattgaaacaacgcgatcttctaaatctaaatgggttggatcaatgtaagtcataaatggttttcctccttattagaattctagtccgttttcacgagcagctgtagctaaagcttcgatacgaccgtggtataagtaaccgccacgatcaaaaacaacaactttatggccggctttaacagcgcgttgtgcaactaatgcgccaacttgttgtgcttgttctactttagtaccttctgcttttacttctttatctaatgttgaggcacttgctagcgtcacacccgctacgtcatcaataagttgagcgtagatgtttttgttagaacggaaaacgttcaagcgtgggcagtcagcagtaccagagatcttgccacgaacgcgtgtatggcgtttttgacgtgtcttattcttgtctggttttgtaatcacaattttcacctcttaatatcgtttaacagcttaagctgctttatttaccagttttaccttctttacggcgaacatattcatcagtataacgaatacctttacctttgtaaggttctggaggacgaacatcacggatttcagctgcgaattggccaacttgttgtttgctaataccgctgatgatgatgtttgtgtttgatgggacttcgactgtaacgccttctggggcttccatttcaactggatgtgaatacccaacgttcaatactaaagtcttgcctttcaattgagcacggtaaccaacaccgataagatccaatgtcttcttgaaaccttccgttacgcccaagatcatgttgtttaagttagcacgcatagtaccgtgcattgcacgatcactttcactattacgtgtaaagttgataaggttaccttcttcgtgcatttcaatcactggactgaaatgacgtgttagttcacctttaggtcccttaactgtgatgttttcaccgtctttagtaacggtaacacctgcaggaacttcgattacttttaatccgatacgactcacgttatgacacctccttattttaagtttagattaccaaacgtatgcgagaacttcgccgccggcagccttttcacgagcttctttgtcagttacgacaccgttgcttgttgagataattgcgatgcctaagccgtttaataccttaggaacatcattagctttaacgtaattacgtaaaccaggttttgaaatccgtttcaaaccagagataacacgttcgttattcttaccatatttcaagaatacacggatgataccttgtttgtcgtcttcaatcacttcgtaatcgcggataaagccttcgcgtttcaaaatttcagaaatttcttttttcatacgtgaagcagggacttctaatgattcgtgatgtaccatgttggcattacgaatacgtgttagatagtctgcgattggatctgtcatgaccatgtggaattaacctccttattgactctttataattaccagcttgcttttttcatgcctggaatttggcccttatgagctaattcacggaggcaaacccggcaaagcttaaacttacgatatacagaatgtggacgtccacaacgttcgcaacgtgaatattcttgtgttgaaaattttgctggacgatgattctttacaactaaagattttttagccaagaaattgacctccctttttatttagcaaatggcatgccaaattgtgttaacaattcgcgtgcttcttcgtcagtatttgaagttgttacaataacaacatccaaaccacgaacgcgatctaccttatcataatcgatttcagggaagatcaattgttcgcgtacacctaatgtataattaccgcgaccatcgaatgattttgcactaacaccgtgaaaatcacgaacacgaggtaaagatacgttaactaatttatctaagaaatcgtacattctttcgccacgtaaagttactttagcgccgattggcataccttcacgtaaacggaaaccagcgattgatttcttagcttttgtgattaatggtttttgaccagcaatcgaacctaattcttcaacagctttatccaaattcttagcgtttgaaacagcatcaccaacacccatgttaagtacgatcttttcgatcttaggtacttgcatgcttgatgtgtagttgaacttttcgatcaacgctggtgtcatttctttaacatatttttcttttaaacggttagtcatgtaaaaagtgcctcctttccccaaaagattatttatcgattgattctccagttttctttgaaacgcgtactttcttaccatcaatcactttgaaacctacacgagtagcttcgttggttgatggatcaattagcataacgtttgaagcatcgatacttgcctctgtgtcaacaatcccaccattagggttttgagcatttggcttaacatgctttttaatggtattgataccttcaacaacaacacggccttctttaggcatagctttgatgattgtaccttctttacctttatctttaccactgattactttaactttatcaccagttttaacgaacattgatatacgcacctccttggttgtctgtaattatagaacttcaggcgctaaggaaacgatcttcatgaaatcactgtcacgcaattcacgtgcaactggcccgaagatacgtgttccttttggagtcttgtcatcattgatgataacagcagcgttttcgtcgaacttgatgtaagaaccgtctgcacgacgagcacctgacttagtacgaacgataacagctttgacaacttcaccttttttgacaacgccacctggtgttgcctgtttaattgttgcaacgataacatcaccgatgttagcagtcttgcgacctgaaccacccaaaactttaatagttaaaatttcgcgggcaccggagttatcagcaaccttaagacgactttctgattgaatcacttataggtcctccttccgtcacttatatatattgagtaacgatttagataataactgctttttcaacgacatctaataaacggaaccgttttgtacgtgacaaaggacgagtttccataacacgcacaacgtcgccaacttttgcttcgttgttgtcatcttgtgcataatatttctttgaatatctaacacgtttaccatattcaggatgtgttttataagtttcaaccacgacagtaattgttttatccattttgtctgaaacaacacggccttggtacactttacgatggttacgactttcttcgctcaaagtaaatagctcctttccatttattatttgttaagttcttgttgacgtaatacagttttaatccgtgcaatgttctgacgaacttgctttaagcgggcggtattttctaattgaccggtagcttgttggaaacgaagattgaataattcttctttgtattggtgttctttttcaagcatttcagcagtggttaattcaataatatctttagccttcatttgactcgccacctacttcctcgcgttttacgatcttagttttaactggcaatttatgtgatgccaagcgtaatgcttcacgagcaacttcttcagaaacgccgccgatttcaaacatgactttttcacgttttactacagcaacccatccagcaggagcacccttacctgaacccattcgaacgccgacaccttttgcagtgtatgatttgtgagggaaaattttaatccacactttcccaccacgtttcatgtaacgagtcatggcaacacgagcagcttcgatttgacggttggtaatccaacttgattctaaagcttgtagcccgaattcaccaaaagtgacttctttgccaccttttgcagcaccgcgcatcttcccacggaattcacgacgatgttttacacgtttaggtactaacatgtttatttccctcctttcgtattgttgttggctttagcgggtaatacttcgccccgataaatccaagtcttaactcctaatttaccgtaagtagtcatggcttcgtcccatgaataatcgatgtctgcacgtagcgtatgcaaaggaacagttccttgagcatgtgtttcgacacgagacatgtcagcaccgttcaaacggccggcaacttgagttttaatacccttagcaccagcgcgcattgtacgttgcatagcttggcgttgagcgcgacggaaagcaacacgtgcttccaattgacgagcaatgccttcacctactaagtgagcgtctaaatcaggtttcttgatttccacaatgttgatgtgtactttcttacctgttaagttgtttaattctttacgtagattttctacttcagaaccgcctttaccgatgaccataccaggtttagcagtatggattgaaacgttcacgcgatttgcagcgcgttcgatttcaatagtagagacagatgcgtcagctaattttgtgttgatatatttacgaatcttaagatcttcgtgtaagaatgttgcgaaatctttttctgcataccatttagcgtcccaatcacggatgacgccaacacgaaaaccggttggattaatcttttgacccacgcgatatccctccttatgcttctttttctgatacaactacagtgatgtgacttgtacgtttgttgattggtgatgctgagcctttagcgcgaggacgaaaacgtttcaatgttggtccttcgttagcataagcttctgtaacgaccaagttttctgcatctaagtcgtaattatgttctgcattagcgatagctgatttcaaaactttgattacgactggtgaagcagctcttggtgtaaattctaagattgcaattgcttctgcaacgctcttgcctctaatcaagtcgactaccatccgtactttacgggctgccatccgaactgattttgcgctagctgttgcactagtaatttgatctgccattgagttcatcctcctttctagcgtgcttttgttttcttatcgtcatttccatgaccatggaaagttcttgttggtacgaattcacctaatttatggcctaccatatcgtctgagatgaaaacgggaacgtgtttccgtccgtcataaacagcgattgtgtagccaataaagctagggaaaattgtcgagcgacgggaccaagtcttgatgacttgtttcttttcgctatcggcttgtgcttcaatcttgttgagcaagtgtgcgtctgcgaatggtccttttttcaaactacgactcattatgaaacctccttcgaataaaaagttcaatgtgacttatgtttaagccgcattggctttagacatgttcaattggaattgattatcttgatttacgatgacgaataataagtttctctgaacgagccttactactacgagtcttcttaccaagcgtcttcttaccccatggagacataggagaaggacgaccgattggagctttaccttcaccaccaccatgaggatgatcgttagggttcattactgacccacgaactgtaggacggatacccatccaacgtttacggccagctttaccaatcttgattaattcgtgttgaccgttaccaacagtaccgatcgttgcacgacatgtaagtaggatcatacgtgtttcgccagaagttaaacgaacgatagcgtatttgccttctttacctaataattgagctgatgtaccagctgaacgaaccaattggccgcctttaccaggttttaattcgacattatggataagtgtaccatcaggaatattagctaatggtaatgcgttacctactttgatatcggcatccacaccagattcaacaaccatgcctacttcaagacctttaggagcgatgatgtatgctttgataccatctggatattggattaatgcaatatttgaagttctgtttggatcgtattcaattgacttaacagtcgctttgataccatctttgatacgtttgaagtcgatgacacggtatttttgcttatgaccgccgccatgatgacgaacagtgatatgaccatgtgcattacgaccagcagtatggctttgggattccaacaacgtcttttcaggggttgtctttgtgatctcagcaaaatctgagctggtcatattacgacgaccatttgtggttggtttgtacttaataattcccacgtgtataccctcctataattattctatttaagtgttgcttaatcttcgaaaatcttgatttcttttgaatcagcagttaaagtaacgattgctttacggcgttttttagtatagccagcatagcgaccttgacgttttaacttgccacgaacgttcatgatgtttacgtttttaacgtttacaccaaagatttcttcgattgcgtaacgcacttgtgttttgttggcacgaacatcaacatcaaatgtgtatttcttgtcgtccattgcagccattgaattttcagtaactactgggcgtaaaataacatcgcgtgcttccattatgcaagcacctcctcaattttagaaagagcagcttgagtaaggattaatttttggttgccaacaacgtctaatacgttgataccatcagcagctacaacagttacgttaggtaagttgcgagctgataatgcagcaaaatcatttccgtcttcaagtactaccaatgctttagtattaacgtctaacttgttaagtacttcagcgaattctttagtcttaggtgcgtcaaagttgaatgcatctacaacaactaaatcattgtcgataaccttttgtgaaagtactgacttgattgcaagacgacgtactttacgaggtaatttgtagctgtatgaacgaggtgtaggaccaaatacggtaccaccaccacgccattgaggtgaacggattgagccttgacgagcacgacctgtacctttttgacgccaaggtttacgaccaccaccacgaacagctgatctgttcttaacagcgtgtgttccttgtcttaatgaagcacgttgcatgatgattgcatcaaacacaacgttttcgttaggttcgatagcccagattgagtcgtttaattcaacgttcccattttggctaccatcttgtttaaataatgttacgtttgccattggtaaaatcctcccttctcagattatttgttacgagctttaacagctgttttgattgtaatcattgagtttttagcacctggcacgttacctttaacaaggataacgttcttttcaacatctgtacttacaaccacaaggttttgaacagtacgttggttgttacccatgcgtccaggtaataatttacccttgaagacacggttgataacagcacccattgaaccaggacgacggtggtaacgagaaccgtgacccataggcccacgtgattgtccgtcttttttaatgttaccttggaaaccatgacctttcgttacaccagtaacgtcaacgacgtcgccggctgcgaaagtatcaactttgatttctgttcctacttcgtaatctcctaatgcgacatctctgaattctctaatgaagcgcttaggagtagtatttgcttttgctacatgacctttagcaggtttgtttgacaagacttcacgtttatcttcaaaaccaacttggatggcttcatagccgtctgtttcgtttgttttaacttgtaaaacaacgtttggagttgctttgataactgttacgggaattaattcgccgttttcagtaaagacttgtgtcatacctacttttctacctaagattccttttgtggtcatggtaacacctcttttctagtatttttaattggttggtacgaattaaagcttgatttcgatatctacaccacttggtaagtcaagtttcatcaatgaatcaactgtcttaggtgtagggttaacaatatcgattaaacgtttgtgtgtacgcatttcgaattgttcacgtgaatctttatgcttatgtggtgaacgaagcactgtataaagtgttctttcagttggtaatgggattgggccagagatagtagcacctgttctctttgctgtttccacaatcttgtcagctgattgatccaaaatacggtgttcgaatgctttcaaacgaatacgaatcttttgttttgccatgtttttccctccttcgtctattttaaaagtagactagctccgtgaaaatttttccggcacgcccgcccatggcaaagcggccgggtgtgtcgcaacctctcacatcttagctactcggtaatctttttgactaccatagtgcgcactcctgctatggaaatagcactttatctatcttacaagatacaacccgataacgcaacccttttttgctgatttatcaaagtttttcataacattttcataaatcttgtagcaagcgtcattcgtggatttctagccatcttttgatacactgaaagcaacttaaatcccctccaggaggtccttatcatgtcccataacgcacttttgattatcgactatacaaatgacttcgttgacccaaacggtgctctgacagccggcaaacccgctcagcaaatcgttcctgtaattatcgaattagctaaccagttcctagcagccggtgattacgtcatcttaccgactgatttacacgtcaaggatgatccatttcatccagagagcgccctattcccaccacataatctagccaatacttggggccgtgagttttacggaccactagctagctggtacaccaagcaccaaaccgatcctcacgtctatgcatttgcaaagaatcgctattcagcatttgctaacactaatctggataatttcttacgcgagcgcgagattgacgcgttaacactgactggcgtttgcaccgacatttgcgtgctccacactgcagtctcggcatacaacttaaattacccactaacaattccagccgctgctgtcgcaacttttacaccgaacgggcaagaatgggcactcgcgcatttcaaaaacagccttggagctacaattatctaatttgacttttaacgatcatttgctatcttaaatgacgggacaatgtacccattctatggattcaaactttagcagccaatattgcaacgattttcatcgtaacatccgccaatcaagaattcagcgaagcgcgcttacaacgctatttaacgatggcttgggatagcggcgcaacaccggtgattgttttgagtaaaaccgatttagtcagcgactctgagctaacaacctttcttgacgccatcgcaagtgtgacattcgacagcgttcccgtcatcacaactggccagacggcatcaaatgttgcagcgactttcaaaccgtatttaacagctggacaatgggtgacatttgtcggctcatccggcgttggtaaatcaaccctgatcaaccagctcattaaagagccttccgttttaacgagcggcattcgcgctgacgatgataaggggcgccacacaaccaccaatcgacaagcctatcaaactgctagcggggccttcatcgtcgatactcctggcatgcgcgaactcggcatgacaagtagcatgtctaaggtactcaagacagtctttactgatattgagacgctcgcacaggactgccgattcaaggattgccaacatcaaagcgaacccggttgcgccgtacgagccgcaatcgatgcaggttcattaacgcctgaacggctagctgatttcaataagctggctatcgaagcggactatagccaactatccgcccgcgaaatcgaacaagcaaaggttaaacgtctgatgggcagtttgaaaacacgtcctacaaaacaaaactaactcagtaagctgtgcctagaaatacaaaaagggagttacgacaaaagtgatttttgtcgtaactcccttttttggagaagtttatatgaaaaagagtttgagttttttgccagggcggtggcaaatcgagttagcggggattgaacccgcatgaaccagtcttaatgatcaacaaatccttgcgccttcgaaagcaagtctctatcaatcaccagaaaaccattcgctgttcttgggaggaattgtctaatgaaaattcatttaatcttgcttttcaaggtaactttttccgcctaactacgcgaagacaacgatcaccttcgttgctcattatcctcgctatgttacgctcaaaagctaaccaccttgaaaagcatttttaccttttcagattatttcttgggaggaattcatctgatgtatacagaataccaaccagttatgaattaaatatgaactttcatttacgaaactgtaaaatcgcatttttacgcacaaaaaaaggactcgtcgcaatgacgagtccttttccaatcgaaaccaatcacttaagattagcggcttattggccaccgttcttcttaatgatttcttcttggatgctcttaggaacagctgagtagtggtcaaataccattgtaaatgtcccacgaccttgtgtagctgaacgtaatgttgtcgcataaccaaacatttctgacaatggtaccattgcattaacgatttgggcattaccacgtgcttccataccttcaacagcaccacgacgagcagttacttgtcccatgatatcgccaagatattcttcaggagcaataacttcaaccttcatgataggttcaaggatttcagcgccagcttgtttagcagcgttcttcaatgccattgatgcagcaatcttaaatgctgattcattagaatcgacatcatgataactaccatcatataacttagctttaacgtcaatcaatgggtaaccagctaagacaccgtttgccattgattctttcaagccttgttcaactgatgggatgtattcacgaggaaccacaccaccgacgatagcgtcttcgaattcgaagcctttaccttcttcgttaggtgtaaattcaacccaaacatcaccatattgacctttaccaccggattgacgaacgaatttaccttgtgcagatgcttgttttgtgaatgtttcacggtaagcaacttgaggttcaccaattttggcaaccactttaaattcacgtctcatacgatcaaccatgatatccaaatgcaattcacccatcccagaaataagcgtttcgcctgtttcattgttggtttcagccttgaatgtaggatcttcttcagcaagtttttgtaaagcaagatctaacttatcacgatcttcttttgattcaggttcaacagaaacttggataactgggtcagggaattccattgattccaagattaatggatgatcaacgtcagtcaatgaatcaccagttgttgtattcttcaaaccgattgcagcagcgatatccccagagaatacttcaggaatttcgttacggtgatttgaatgcatttgtaataaacgaccaacacgttcacgtttgtctttagttgcattcaaaatgtatgaaccagattgtaatgtaccagtataaacacggaagaatgttaaacgaccaacgaatgggtcagtagcaatcttaaatgctaaaccagcaaatggtttgtcatcgccagccatcaattcaacttctgaatcatcttctgggtttttagcgttataaggacgtacgtctaatggtgatggtaagtaatctacaacaccatccattaacatttgaacacctttatttttgaaagctgaaccagcgaaaactgggaagaatttcaaatcgatagttgcttgacgaatagcagctttcaattcatctttagaaatttcttcgccttctaaatatttgtccataatgtcgtcattaacatcagcaacagcttcaactaattcggcacgacgttttgtagcttcttcaaggtagtcagcaggtacatcaactgtatcccacttagcacctaattcatcttcatcatagatgtcagcttgcatttcgatcaaatcaataacgccttggaattcatcttcagcgccgattggcatttgaacagcatgtgcattagcttgtaaacgatcttccaatgttgtcattgagtaatcgaagttagcaccaagtttgtccatcttgttaacgaaaacaatccggggaacaccataagtagttgcttgacgccaaacattttcagtttgaggttcaacacctgattgagcatctaagacagtgattgcaccatctaaaacacgcaatgaacgttcaacttcgattgtgaaatcaacgtgtcctggtgtatcaatgatattaactcggttacctttccattcagctgttgtagcagctgatgtaattgtaatcccacgttcttgttcttgttccatccagtccatttgtgaagccccttcgtgggtttcaccgatcttatggattttaccagtgtagtacaagatacgttctgtggttgttgtcttaccagcatcaatatgagccatgataccgatattacgcgttttgtctaacggaaattcacgtttgtttgccataagtgaatattactcctctcgaatattaagctatatacaacaagaggccattatatgatttgaatacatataacagccaaccttgttaatcttaccagcgataatgtgcaaatgcgcggttggcatcagccattttgtgtgtatcttcacgtttcttaactgcagcaccagtgttattggcagcatccatgatttcacgtgcaagacgttgatccatggtatgttccccacgtaggcgagcatagcttactaaccagcgtaaacctaaagttgcacgacgttctggacgaacttcaattggcacttggtagttagaaccaccgatacggcgagctttaacttcaagtactggcatgatgttgttcatagcttcttcgaacacttctaatggttcattaccagtttcttctttaataatatcaaatgcatcgtataagattgttgacgcagtaccacgtttaccatcaatcattaagcggttgattaagcgtgaaaccaatttagaattgtacattggatcaggtaaaacgtcacgttttgcaacatagccttttcttggcatcctgataacctcctcaagatatttaagtccttgaagtaacacacagtgtcatttaaacttcaatcgactttttcaaatttttttgtgtgttattttttaggtctcttagtaccatacttagaacggctttgcatacgaccgtcaacaccggcagtatctaaagcaccacggataacgtgataacgtaccccaggtaaatccttaacacggcccccacggataagaacaacactatgttcttgtaggttatgaccaataccaggaatataagctgtaacttcgattaagttagataaacgcacacgcgcatacttacgtaaagcagagttaggctttttaggtgtcatagtacccacacgagtagcaaccccacgtttttgtggtgctggattatctgtagcttttttcttcatactgttgtagccaaagtttaatgcaggtgcatcagactttgaagttcttgatttacgacccttacgtaccaattggttaattgttggcatttgaaggttcctccttccttgatctgaaagttatttttgagttttaagtccacacatccaggtggttctttttttgcgataaaaaaatggcaacctagattgcgtggattgtaatgcatttttagacgtcagtcagcatgtctgaatatcagaaaacttccgtaaaaagcacatctacaagaatagcatgcacaactacgaaagtcaacgtgctataagccagtttttcagaaaaagttgcgcccttttttcgtagttatcataaaggagatgacacgtttgttaatatattttttaacctttgttattggcgcgtgttgcgcctcttttttaactgtttgcgcttggcgttggccactcggtttatccatcacatggcctggttcacggtgcgacttctgccatcacgccctcgcttggtacgacttatgtccaattatcagttacctcattctcagaggtcactgccgctattgtgatactcgaatccagcaccatttttttactagtgaggttattggcggcttgttagcgtgttgcttagccagtcaatatttcacaccacagattggctatttattgcttatcctttacttgttgagcctagtcgatattttccatacagctctatacccagttcctatggtactggcttttatgcctttgtttattgactactggccgacaaaccattggctcagtgccctattgattggctgcaccttatctgtcatcaactacttttcagatggcatcggtactggtgacattgaattattggcaattcttgggttgtggtttggattggaggtcaccctatccatgttattaattgcctgtctcctctgtttaatcaaatatctcatcgatagtctccgccatccagttgtcctcgccttagtcggacaccgcccaattccatttgtcccgtatatcagctacggtgtcttaatcgttttgtttattgtaaacacataaaaaagggcctcaccatgtcggtgaggccctttaacgtgcaatttagagcagctgttctaaattgacactcagttattcttttgtttcttctttcatctgtgcttcgatgtcactgattgagtagacattttctgatacagcaccgactgtcttaggttccatatgacgatacttcgccataccagtaccagctgggacaatcttaccgatgataacattttctttcaaaccaagtaatggatcgctcttaccgcggatagaagcatccgttaagacacgtgttgtttcttggaatgatgcggctgataagaaactatttgtttccaatgatgctttcgtaataccaagcaagacaggacgacaagtagcaggtacgccaccgctaattaaggtttcgtggttacggtctgtaaattcactaatatccattaatgtaccaggtaagatttctgtatcacctggatccatgacacggactttacgtagcatttgacggaccataacttcaacgtgtttatcgccgatttcaacaccttgcatacggtaaactttttgaacttcatgcaagaggtagttttcagttgataagacgtcacggactttaattaattgtttaggatcgacagaaccacccgttaatttagaaccacgacgaaccatgtcaccttcgttaacgatgacgttggctgtgtaaggcacactatatgaacgtgtatctgtttcaccttgaacagtgatttcacgtgtatgttctgcagggttttcttccaccgcaacaacttcaccagttacttcagtgattgttgcaagccccttaggattacgcgcttcgaaaatttcttggatacgaggcaaaccttgagtgatatcttcaccgccggcaaccccaccggtatggaagttacgcatggttaattgcgtaccaggttcaccgattgattgagctgcgactgttccgactgcttcaccaacttcaacttcttcgccgttggccatgttacgaccgtaacattttttgcagacaccgtgttttgtgttacatgtgaagacagaacgaattgtgacttcttcaacaccggcatcaacaacagcttgagcaagttgttcatccattaattggttacgttgaaccatcacttcacccgttgttggattaacaatggtcttcattgcacaacgaccaacaagacggtcatacaatggttcgattaattcattaccttcgcgaattgagtgaatgagaagaccacgatcagtcccacaatcttcttcacgaatgataacgtcttgagcaacatcaactaaacgacgtgttaagtaaccagaatcggcagtcttaagcgccgtatcagtcatccctttacgggcaccatgggtagacataaacatttccatgacagagaggccttcacggaagtttgatgtaacaggaacttccatcatcccaccattaggagcagccatcaacccacgcataccagcaagttgcgtaaagttagagatgttaccacgagcaccagaatcagacatcattgagattgggtttgttggatcaaacgaatctgtgagtcgttgttggatatcgtctttagcatcgttccagatttcaataacgcgcgcatggcgttcttcatctgtaatcaacccacgacggaattgtttagaaaccgttgtgattttcttatgggcttcatcaacaatttcttgtttttcaggtaattgaggaacatcggcaaccccaactgttaaaccagcatgggtcgcttgaacgtaacctaaggtcttcatatcatccaataagtcagatgtccgttgaaccttatataccttgaagacttgcgcgatgatatcgcttaagaagcctttcttaaatggtaagatcactggggcacttgagaggtagtcatgaatatcttcaccgttatcgatgaagtatttatctggcacaccattcatcaagttatctgttgttggttcgttcaaatatgggaagccagttggcatgatttcgttgaacatcactttaccaacacttgttaccataatcttgtggcgttgttcgtcagggaatggacgattatccatatcaacaactgacaaaccaatccgactgtgtaaatgaacgtgacctgtttgataagccattaaaacttcgtttgtatctttgaagatcatgccttcgccgagactacctttttgttcaagcgttaagtagtagttccctaaaacaacgtcttgagaaggtgtaacgattggtttaccatcttttggtgccaaaatatggtgagcggcaagcattaacattcttgcttctgcttgtgcttcatcagataaaggtacgtgaatcgccatttgatccccatcgaaatcggcattgtaagcttcacaagctaatggatgaagacggattgacttaccatcaaccaagattggttcgaatgcttggataccaagtctatgcaatgtaggtgctcggttcaatagaactgggcgttccttgatgacatcttctaaaacatcccaaacatcgtcatcttgacgatcaattttacgttttgcatttttaatgtttgaagccatatcgcgtttcactaattcgtgcatgacgaatggtttgaacaattcaagtgccatttcacgtggtaatccacattgatagaacttcaatgtaggaccaacatcgataacggaacgaccagaataatcgacacgtttaccaagtaagttttgacggaaacgaccttgtttccctttcaacatgtgtgaaagagacttcaatggacggttaccaggtccagtaactggacggccacgacgaccattatcaatcaaagcatcaacggcttcttgtaacatccgtttttcgttttgaacgatgatgcttggtgccatcaagtctaacaaacgtttcaaacgattgttacggttaatcacacgacggtacaaatcattcaaatcagatgtggcaaaacggccaccttccaattgaaccatcggacgtaaatctggtggaataactggaatagcatccataaccatccattcagggttattccctgatttacggaaggcatctaagatgtccaaacgacggatagcacgcgttctcttttgaccttgtgctgacttcaagtcttcctttaattcagcaacttcgccttcaagatcaacgtcacgtaacaattctttgatggcttcagcacccatcttagcgttgaaacgattaccgtattcatctaatttttcacgatattcacgttcggtcatcagttgtttcttttctaaggctgtatcgcctggatcaatcacaacgtatgatgcgaagtaaataatttcttccaatgcacgagggctcatgtctaagacaagacccatccggctgggaatccctttaaagtaccagatatgtgttactggtgctgcaagttcgatatgtcccatgcgttcgcgacgcacttttgaacgtgtaacttcaacgccacaacgatcacagacaattcctttataacgaattcgtttgtacttaccacaagcacattcccaatctttcgtaggtccgaagattcgttcatcaaaaaggccatcacgttcaggttttaaagtacggtagttgattgtttctggctttttaacttcaccatacgaccaactacggattttatctgaagatgctaaaccaatttgcatactttcaaacttattgacatctatcaaagggccgacctcctcataatttatagcacgctttattcagcagatggatctactgtatcagcatttgctgcttgtgctttttcagcttcttcttgtgcctttttgacttcttgttctttagcgtatttagataatgcatcgatgttttcgatatcatcatcatcgtcgtccatatcgcgtaattcaatttcttgattatcgatatccaagaccttcatatccaagccaagtgattgtaattctttaaccaatactcggaatgattccggaacacctggttttggaattggttcacccttaacgattgcttcgtatgtcttcacacgaccaacaacgtcatcagacttgtaagttaagatttcttgtaaggtataagcggcaccgtaagcttcaagagcccaaacttccatttcaccgaaacgttggccaccaaattgagctttaccacccaatggttgttgcgtaacaagtgagtaaggtccgattgaacgtgcatggagtttatcgtcaaccatgtgggctagtttcatgtagtacatgacaccaactgacacacgtgtatcgaatggttcaccggtccgaccatcataaagaatgctcttaccatcagaaggcatgtttgcttcacgaacagcgtcccataaatctttatcttgcgcaccatcaaagactggtgttgcaacatggatgcctaagtttctagcagccatcccaagatgtaattcaagaacttgtccgatattcatacgagaaggcacacccatgggactcaataagatatcaactggggtaccatctggcatgtatggcatatcttcttcaggaacaacgattgaaacagtccctttgttaccatgacgaccagccatcttatcgccgacttggatcttacgtttttgtgtaatgtaaacacgaaccatcatgttaacacctggtgacaattcatcgccagcttcacgcgtaaagatcttaacgtcctggataatcccgccgccaccatgaggtactttcaatgatgtatcgcgaacttcgcgagccttttcaccgaaaatagcgtgcaataagcgttcttcggctgataattctgtcacacccttaggcgttaccttaccaactaaaatgtcgccatctttgacttcagcaccaacacggacaatcccgaattcgtcaagatccttcaatgaatcttcaccaacgttaggaatttcacgtgtgatttcttcaggtccaagttttgtatcacgagcttctgattcgtattcttcaatatgaattgaagtatataaatcttctttcactaaacgttctgaaagaacgatcgcatcttcgtagttatacatattccaagtcatgaaagcaatcaatgggttttgacctaaggctaattcacctttttccatagctggtccatcagcgataatttcatcaacatcaacgtgatcgccttttgcaacgattggacgttggttgtagttcttaccagcatttgaacgacggaatttcattaattcgtacgtatctaatgagctgtcttcacgacgaacgcgaatgacttttgcatcaacatattcaacagttccggcatgttgtgctaataaagcaatccctgaatcgtgggctgctttatattccatccctgtcccaacaagtggtgcatgtgggtcaactaatggcacagcttgacgttgcatgttagcacccatcaaggcacggtttgaatcatcattttccaagaaaggaatgcaggccgtagcgacagcaactacttgcttaggcgaaacgtccatgtaatctaacttgtcgattgaagtttcaatattgtcatctttgtaacgtgctaaaacagtatcatcaacgaatgaaccatcatcgtttaatggtgagttggcttgcgcaatgacatagttatcttcttcgtcggctgttaaatagtcgatcttatcagtaacatcatgcgtatcccaactaacacggcgatatggtgtttcgatgaagccgtaacggttaacaacagcgtaactagccaaactgttaatcaaaccgatattagggccttcaggggtttcgattgggcacatacgaccataatgggtatagtgaacatctcgaacttcataaccggcacggtcacgagtcaaaccaccaggtcctaaggcagatagacgacgtttatgcgtcaattcaccaaggggattggtttgatccatgaattgtgacaattgtgatgaaccgaagaattccttaattgaggcaacaactgggcgaatattgatcaattgttgaggtgtcacggtgcttgtgtcttggattgacatccgttcacgaaccacacgttccatccgtgataaaccaattcggaattggttttgtaacaattcaccaactgaacgaatccgacgattccctaaatgatcaatatcatccgttgaaccgagaccttcttgtaagttaaagaagtagttcattgaagcgatgatatcagcaggaatgacatgcttaatcttggcatcgatatgaccgttaccgattaagttgatttctttatcaggtgttttttgtgagtacactttaatcacttgaagcgtcattggttctggtaagacaccttcatcagatggttggtaagtaaccgtcttgaagtcttctttgtctaagtatggtgccaaagcatccatcacttgacgatcaacaactgtatctttagcagcaatcacttcaccagtatcgggatcagcaagtgtttcagctaatgtttgacccaataaacgcgtctttaagcttaatttcttgttgatcttgtaacgaccaacagcagctaaatcataacgtttagcatcgaagaaacgtgcataaagtaatgaacgtgagctatcagctgtcttcggttcgcctgggcgaagtctttcgtagacatccttcaaagcttcttctgttcttgagtcgtcagtattcttatggatatctttttctaacgtcaacattaatgaatcgttgtcacctaagatatcgataatttcttgatcagaaccgtaacctaaagcacgaactaaaacagacattggaatcttacgtgtccgatcgatccgaacgtatgcaatatccttagcatctgtttcaaattctaaccatgcaccccggttaggaatgacagttgtaccataagttgtgcggctgtttttatcaacagcgctgttgaaataaacgcctggtgaacgaactaattgagaaacaattacccgttcagcaccgttgatgatgaaagtcccttggtcagtcatcaatgggaagtccccaaagaaaacgtcttgagatttaatttcaccagtttcatggtttgttaatttcaaagtaacgtgtaatggtgctgagtagttggcatcatgttgtctagcttcttcaaccgtgtatttaggttcaagaagttggtaatcaacgaattctaatgataagttaccagcaaaatcgtcaattggcataatgtcatcaaacatttcacgaagcccttcgtctaaaaaccattgataggaattagattggatctcgatcaagtttggtagttctagcacttctttaatccgtgcgtagcttctacgagtacgatgtttaccgtaattcactaagtgtcctgccaaattgttcacccctctataagttttccgcagcctcattgttacaaaaatatgacaaatattaagaaaatattacatcgccatttttaggtaattttgagcagaaaaaaaacaaaaatagttattttaagctgaataaatcagactaactatttttgtttttcatgaataccgtgctggacaatagatcagcacaataaatttttctacggattttcgcagttactgtataatatacttcttttactactaaaagtcaataatctgcctcggtgctacttatcatagataaattgattattataaaatttagatttggcgctcaaggccttatcaacctttttcaatcccttttcttctattaatgtctttttcgttgaaaatagatttgttcctaagcctaaacgttctcctttaatatcaacccccattgcggcgagcgtcgttgggaacatgtccattgtgctaaactggcgattcttggtttgaacctgacttgcttttggtgcatttaaaatcaaattaaatgcatgccgtttattggccggaatcttcttataatactccacatccatgcctaaatggtctccgttgacaatgatggtcgtattctgataaaacgactgcgtttgtgcccacttaataaattcaacaatttgatgatcagaaaaggcgataacgtttgaatactggtcaccatacttttctggcatatccggttctggatacccaccaatgtggtgcgtattctccgttagcatcgttaagttaaatggctgatctgatttgctaagctccaacgcactttccttagcgtattcgaataactttgaatcttcatagccccaccaaacataatagtcttcaggtaaccgaccatctttgcgcgcagttaacaaatcatcaatttgaacattaccgtgctgcgtaaaatatgatcgtcgaccaccaaaagtcgcatccgatccaagtaagattttttgctgatagccgtgcttgtccaaaatattatttaatgacgtgacgcctggtaggaaatgattctttttatctgtcgcataggaattcccatccaccggcactttcaacggtaatcctgatgtttgggcgaccattcccgcaactgtccagcctgttcctggtaattgttgggcaccaccaaatgatcggttagaatttgagaagtgaacaccctcttgctcagctaacgccgtcaattctggtagtaaattggttttcatctgcccacccatttctcttgatgttgctgtagattcgagtgactcagcataaatataaattagatttcgtttttgttttgggaacgttaattcggttttattcggtgctacataattttcttcaataaatggtgaattcgccgttagatattcgtaaaaaccaacagcatcaattttaatcgcagcaaccgtcgtcaaaccacaaaacaataacgcactgaccaatacaaatcgttttgccttgagttctaagtggtgtgttattttatgagtgaccaacagttgcaggtgtctgatatagttgcagaacaaaaaaacgctgattaaacaagtaatggcacctagcaccggaccgccgataaatgaattaataaaaccatcgtcaacacctgtcatcggttggcgtaagttataaactatctgctcgggcgttaacaagccaaaatttgcctttgtccaaaaattagctgacaacaagaaatacccaactgatattaataaggcaccactaaaaatccaccagctaaaccaatgtcttgtgcgtgtgactggtaccagttcaaatgttaaccatttttggcgccaccttcttgtcagcaacacgacgccttgaataatggtaatcaacataataaacttgagtaaaaataacttttggaacaaaccatcactaaaatgaataacatgaccagtcaacccaaaagtcactaaaatcgttaatcctaatacaagcaccaaattgatcaacataccaactaattgaataaattggcgatcattgcgttggacagtagcacataaaaaaggtaaacagacaaacaagtagatcatcgcaataaataacattatgtatttgctccatttctaactatctcatttaatcatagcattttatggctgtatcgcctacccacccttttaacaaaagtctctaataacaatcttcaagcccctcacggaatcatttacaaactcgcaacttatcatttacgttttttacacgaattagcggtcaatctttacacgacgtctctatactgaacttgtacccttaaatcagtcctcaggaggaatcattatgaaacgcatcagtatggcattactcacagttggcgcggccgctcttttattagctggttgtcaaggccaatcaaaaagtgcaagtcaaagccaggatcaaggcgctaaaattactgcagttggttcgacagcccttcaaccccttgttgaacaagctggcgatcaatatcaaaaggataaccctaaagtcaacgtcaccgttcaaggtggcggttcaggaactggtttaacccaaattagtggtggcaacgtcacaatcggtaactcggacatcttcgctgaagaaaaagatggtatcgatgctaagaaacttgttgatcacaaagttgctgtggttgcaatcgcacccgttgttaataaaaagttaggcatcaaaaatttaaccagtgcacaattgctaggcatctttaaaggcgaaatcacaaactggcaatccgttggtggtcctaacgaaaaaatcaccgttatcaaccgggcccaaggaagtgggacacgtcaaacgtttgaaaaattaggtcttaaaaccgacaaagttgttaccagccaagaacaagattcctctgggactgttcaaaaaatcgttgaacaaacgccaggcgctatcagttacctcgccttcccatacatcaaaggtaacttgcaagccgttaagttaaacgacgttgaacctaccgaaaagaacgtttcaaccaatgcatggccaatctggtcttacgaacatatgtatactaagggcgcacctaactatcaaacagcccgtttcatccacttcatccaatcaaaagacgttcaaaagacaatcgtccctaaactgggctacatcccaatgacgcaaatgaaagttgaacgccacgttgatggcactatccaagatcaatagtttccagaagtcgcgctaaactgcgcgactttttaattggtatatactaataaaaagcttttaaacaaagtaatttgcatttatatttatgattggtataatcgaactattagtttatcaaaggagtttggcgaatgattaacaataaaatgaaagcgttatccgaaaaataccccactaaaatggcaattacttccgaaatcatcaacttaaaggccatcttgaacctccccaaacccactgaagccttcatgagtgatttacatggcgaatatgatgccttccagcatctcattcgcactggcgcagggaatctccggcaaaaaattgcagaggtcttttccggtgaaatgactgaagacacaatgcaggcgttcgcttttttagtttactacccaactgagcggcttgcactcaaacacgcacaactatctgctagcgaactcgatcagtggtacctcaccacttttaaacggttaatcgacctcttaaaatttgtctccacaaaatacacacgctcaaaagtccgtaaagcaatggcgcccgatttcgtctacattaccgaagaattaatgtacggcgatgtagctaacagcgataaaaaacgctacttccaagaaatcacgacgtccatcatttcgatgggccaagccgatgccctaattatcgccaccagtcatacgattcaacgactagtggttgatcattggcatatcatcggtgacatttacgatcgtgggccgcgtcccgatctgattgtcgaacaactcaccaagctccccgcggttgatattcagtggggcaatcatgatattctctggttcggcgccgctagcggttctcaactatgtatgctcaaccttttacgcatttgcgcacgctacaacaatttagccatcatcgaaaaagcttacggaattgatcttagcgaactggttcaatttgctcaacgaacttatcagcccaatcccgccttcgaaccaaaggttgctgccaatcaacccgcaatctcaacagctgaaaagaaaagcatcaaccaagtgcaccaagccatcgccatcatgcagtttaagttggaacaagccgtgattaaacgcaatcctgatttcaaaatggaccaccgcttaaccctcagccatgttgactttgaacagcagacaattcatctaaatggtcatgactacccacttgataacacctgctttcaaacagtcgaccccacccacccagaaatattaacttccgatgaagcagccattgttacatcattgctaaacgcgtttacccactgccaaaaactacgcaagcatctccgttttttaatcgacaacggtaacatgtaccaactctacaaccagaacctcctttttcacggctgtattccagttgatgaagccggcaacttcctcacgctaaccctcgctaaccgacaatacgctggtaaatcattactcgacttcttcgatcaccaaattcgaacgagcttcgaccacccgctcaatcaagataatttatccaccgatttactctggtacctgtggacaggaccgctctccccactatttggcaagaacgcgatgacgaccttcgaacgctacttcagcgccgcccctgttttacacgaagaaaagaagaacgcatattaccaactccgccatcaggaagacttcattgagaaactcttgttggagtttggcttaacgccagaaacggggcacattctcaatggtcacacacctgtcaaaaaaggccacaatccaatcatggctaatcgcaaaatgatcgtgattgatggcggcttttcaaaagcctatcaccacacaactggcattggtggctttacgctcttgtacaattcgtatggaatgcagttagtcacccatcagccgttcaccacacgggccaatgcaattgccaagatgcaagacattatttccacgcgtcgagtgattgatcaagttagtcaacgtcaacgtgtcagtcaaacgaatatcggcgctgcgattaaaactgaaattgaacagctcacgacccttttagggcaaaaaaaataaggtgtcagaccacttggtctgacaccttatttacgtttaaacagttactttatcagtcttactggtaatggtaattttacctttagttgcgccaattgtcaccggtacacccatcgtaatctcgccagcaagcaacgcttcactcaactgatcttctacttgggtttgtagcgcccgtcgaattggtcgcgccccatattcaggatcgaaaccggctttggcaacaacatccatcgctgcagctgtcatcttgatttgaatcccttgttccgctaaacggcctaagacattcttcgccataatcttcacgatttcgcgcaattcaggctgggttaaggaatggaagacaaccgtttcgtcaattcggtttaagaattctgggcggaaggctttcttcaattcttccataatgcgcccttgcattgctttataatcagcagttacatctttaaccccgaacccaacggatttatcatcacgtaaggctgtcgcacctaagtttgatgtcataatcatgatcgtattacggaaatcaaccttacgtccttttgaatcggttaaatagccgtcatccaagacctgcaacaagatattgaagatatcagggtgggccttttcaacttcatcaaataaaatgacggaatatggtttattgcggaccttttctgttaattggccgccttcttcgtagccgacatagccgggggccgccccaactaaacggctcgtgctgtaacgttccatatattcagacatatcaacccgaatcaagttgtcttcagaaccaaacatagcttccgccaatgctttagctaactctgttttaccaaccccggttgggcctaagaacataaatgaaccaattggtcgtttgggatctttcaaaccactgcgcgcacgacgaattgcacgtgaaacggcagaaatggcttcttcttggccaacaacccgtttatgcaagactttttcaagttgcatgagacgttcgctttctttgcgttgcaactgagtaacaggcacaccggtccattgcgcaaccacttgagcgatgtcttcagcagtcacttgaatgtcactgcgaacaccgttttcttgttcggcagcttgtaacttggcaatcttggccttagtggttacttcttgctcatgaatcgtcgccgctttttcaaaatcttgcgcgcgaacagcggcttctttatcgtcatttaaagtttgtagtttttgttctaatttatccaacggtgtcttctggttaacagcatccaagcgcactttagccgtcgcttcatccattaaatcgattgccttatccggtaagaatcggttcgtgatgtagcgatttgataagacaaccgcttcatgtaaagcttcatctgaaatcgcaatcccatgatgagcttcataacgtggacgtaatccctttaagatttgttccgcatcttctggcgttggttcattgaccgtgacggtcgcgaatcgccgctctaaagctgcatctttttcaatgtacttttgatattcatctaaagtcgtcgcaccaattaattgtaattcaccacgcgctaatgctggtttcaagagattagaagcatcaattgccccttcagcgccacctgcaccaatgagggtgtgtaattcatcaataaagagaatcacttgcccatctgcatagatttcatcgataatcttcttcaaacgatcttcgaattcaccacgatactttgtcccagcaaccaatgaccccatgtcgagcatcatgagccgcttttgctgcatgtcacttggcacatcgccattgacgatgcgttgcgcaaatccttcagcaatcgctgtcttaccgacaccgggttcaccgactaagacgggattattcttcgaacgccgggctaaaatctgcacaagtcgccgaacttcttcatcacgacccacgaccggatcaatttgattgtcacgagcaagttgtgttaaatcgcgcgctaattggttcaacgttggtgtcccagcttgatcggcattattcttagctgctttagcccgttttttagcggttgccgtatccacacccatcttttgaagtagtagttggcgtgttttagctaaactaagtcctaagttcaataagatccgcgcagcgataatatcatcatcacgtaaaagtgctaataataggtgtgctgtgccaattttaaccgaattagcttgttgcgcttcgacccgagcaatatcgagtacttgtttggctttgggcgaatatggtaaataaccgccaatgccagaagcgattacagcatcgccatatccggttaagcgttcaatttcttcaaggacatcggtcgaattgacacctaattcgcgtaaagtagtcccagcaattccctcattttctaatacgattgctaataggagatgttccgttcctagtgcatggtgattaaatttctttgcttgttcttgtgccatcattaagacgttttttgcacttggtgtaaatagattattcatggataatcccccactctttacttaatttcatatcgtagtcgttctaacactgcaactagaatctgtgctcgaagctgctcttctaattgtttattattaaccgctaatgtctgtggactcgttgccgcgagtatcaaattgccttccttttgcgaaagaatttgttcatcatatagtttctggataatggctaaggtgtccgcctgggaaatctgcgtatcaacattttcaattaacgcttctaaaaagtcccgatcatcgagaaattgaaccttgacgatccgaatataaccaccgccgccacgtttactattcacgacataaccgcgctgctcagtgaaccgcgtgttaatcacatagttaatttgggacggcacacaattaaaaagcttagcaatttcggagcgtctaatttcgatttgttcattgtcagccagtatcttttttagataggcttcaataatatccgagatgttctgactttgcaaacatatcagccccttcatttagtcttctgcgtttttcagtgtcaaaagtttaactttgactaacgttgactattattataacgattatcagtacaaaatgaaagtttactgacttttagtagctaatcaattggacgcacaaaaaaagacttgtcatcaacaagtctttgagagtcgggaaaacaagatttgaacttgcgacccctacgtcccgaacgtagtgctctaccaagctgagctacttcccggaaactattttattacgggtacaaaaaaagcggaagacgggattcgaacccgcgacccccaccatggcaaggtgatgttctaccactgaactacttccgcattttttattaacatttttgtatccagttaaagtatcgaaagtgaaagtggtttacgaaatctaagtccatcaaaaaaccgatatgtaaaaacattagtttgacatatcggttgagataaataattttaattttagagactaaaaataggttgtaatcatccggttgattcccgaattcttacaacctatataattggttaacgtttcaattcatatttgtgctttgtctcattaatttttcggctgtcattcattttgatcgcgccgacgcgcaatgaagtcatgaaccttaccgcgactggcgttaacatgcccatgcagtgcttcttcaatcacaacattcaagacagccccaaccatcagaatcgttgcggaataattcagccacaagagtaagataatcaccgcaccgattgcaccgtaactattccatgacgtgccgaagtaacgaatatacaatgagaaggcttgtgcaagaattaaccagccaaccgttgtcagtgctgcccctggcagaacacttcgcaatcgcattttcacattcggaacgaagaaatagatgaaaatcagcagtaggaacaaggcgatccccgtcactggccattttaaactactaaaaatattaacgtatgtcttaggaatgttaaagattgggactaataattccaaaacttgttgcccgaatgtaaaaacaacaattaaaccgactaataatagaagtaataataatgtactccctaaagaaatcaggcgttttaaaacaaagttctgaactttttcaacacgatacgcgcggttaatactattttttaaggcattaatccccatgctcgctgcccacaacgtccccaagatcccgacggacaataagccatcattgcgtttcttcaatagggactgcagaactggcataatcttgtcgaatatcgtgggcggcaccgccgtttggacgtaatccgccacactcattacatctaactggaagtacggtaagatgttcccgataacgattaatagtgggaagattgataataacgaataatatgcgattaccttcgaattatcactaatgcttgcttctgatgaacgcaacatcattaacttcaccacagcaatcaacttctgccgtccggataagtcctgttttaccaccggtaactggttttgattgtctactgtcatatgtcactccaaattctcttttacccattagtcgttctacctgaaaggcttatttttccgacttcttaaggcatatttatcatttctattatacacgaattaactatgggctaatagttttctgaaagcaaaaaaagaaaccttctcattttagagaaggtttctaaattttatagtaaatatttagcatccatttctggatcttgtgaggttagaatcttaggaccatctttggtaatcgcaattgtgtgttcatattgcgcacatggtgtgccatctgctgagacgtaatattcccagtcttcgccagggacttcttttgacttgatgtgccatgtgccacctaagatgaccattggttcaattgtgatggtcatcccttctttaaggcgcaagcccttgcccgcttcaccgtatgaaggcacgtttggttgttcgtgcatcgttggttgaataccatgtccaatcaattcacggacgtcaccgtagctgttttcaacttcggtatattgttggatggcgtggccgatatcacctaggcgattgccgacaacggcttgatcaatacctaagtaaagtgctttgcgcgtatcgtccattaatttttgtaattctggtgcgatttcgcccaccgcataagtccagcaagaatcactttcataaccgtccaagttaacggtcatgtcgacactgacaatgtcgccttcttttagaattaagttcttccgtggaatggcatgtgccacttcctcattcacgcagacacaagttgcgtacttgtagccttcaaagcctttttcagatgctttggcaccgtgttgttcgatgtagtcgtttgcgaattcttcaattgcccagctcgaaatacctggtttgatgatgtcgcgcaaaccgcgatgaacgccggcaatgatggcgccagaagcagccatccctttaatttctcgttcagattttaatgtaatcaaaatgaaacctccaatattgttaccattgtagcctttaattgtatctatttctatattatacgctatctgccattaaaatggacgaatcgtcgctttttagttcaattaaccgtgaaagagccgttgcaccttttcttaataaggggcttttgctataatgccttatagtataattcgttaattgcggccactgagcgccgcgtacgtgaaaggatgtcccaataatggcaactgctaaagtagtctatgcaagtatgaccggcaataacgaggaaattgccgaaatcgttgaagaagccctcgaaagtttgaacgtcgacgttgaaaccactgaaatctctcaagcagatcctgccgattttgaagacagcgatatctgtatcgtctgcagctacacctatggcgatgatggcgatctccccgatgaagccgttgatttctacgaagatctcaaggatattgatttaactggtaaagtctacggtgtctgtggctccggtgatacgttctacgatgacttctgtaaagtggttgatgattttgcagccgtcttcgaacaaaccggcgcaacaaagggttcagacgttgtcaaagtcgatctatcagcagaagcagaagatattgaacatcttgaaaaattcgtatcagagattgttgcaaaacaaagtgcactataagctcggtcagtatccgagcactaacctagtccggcacaggatactagcttataaagcacgtttcaaggcagagtgcgtttgaaacggttatgctttgagcattaactggatttgccgaataggtgatgcaatcacctatttggtaaatttggttaagcgcagaagtatgtttcaacaagcacgtttcaaccaatcttccatgggccgcggttacgtccctttttaccgcggcccttcttttggtcttttagaccttaataaatcaaactaggagctgtctttatggctttcattaaacggttagtgtttaaataccgcgattttttgacctatacgatttttggttttttagcatcgttggttaatatttttacttactgggtatttcgccacaccattatttggccgtatttactcgccaatacaatggcgtggtttgtcgcgaatttatttggcttttttaccaataagtcgcttgtattccaatccaaatacaccacgtttggcgctgtgtgtcgcgaagtgctttcgtttttctttttccgtggtgtatcctttttcttggataacggtttgatgattgtcgccatctccttcttagggtggcagagtatgaccgccaagattatcgatcagttaattgtcggcattgtcaactacatcaccacccgctacactttcaaaaaaacagaacaacaaatggcactccggggtcggattctccggcgatacaatgccattttgaaaagaggtcacaatgattaaagccatccaacaactcattcaaaaatactgggaacaattaatgtacttggtctttggtgtcttaacaaccctagtcaacatggtcgttttcttcggattagaccactatacaactatcaattatctcgtcagcaacacgattgcctggttcttatccgtgctatttgcctttttcaccaataaaacgtgggtctttcagtcaaaatatacaactttaaaggacttttcccgtgaaatggctagtttctttttcttccgtggtatatcatttataatggatacggcaattatgtttgttgggatttccttattggtatggcccaacatgattgttaaagtgctagatcagattatcgtgattttagcgaactatgtatttagcaaatggattttcaaagatacttcggaggattaagatgactaagacgatttcaattattgtaccctgttataacgagcaagaatcaattccgcttttctacgcagcagttgagaaagtagcggctactctagccgaccaccgcatcgaatacatcttcgttaacgatggttctgctgatgaaagcctggcggaaatgcgcgcgttacaggcacaagaccctgaacacgttcactacatttcattctctcgtaactttggtaaagaggctgccttgtatgctggcttacaagccgcaactggcgactacgtttcagtgatggatgttgacttacaagatccgcctgaactattacccgaaatgattcacggcattgaagtcgaaggctacgactgtgtcggcactcgccggacaacacgtgcgggtgaaccccccgttcgttcgttcttcgctaaacaattttacaagattatcaaccggatttcacaaactgaaatcgtggatggtgctcgtgattatcgcttgatgactcggcagatggtcaatgccatcttagagatgtctgaatacaaccgtttttcaaaagggattttcagttgggtcggctttgacaccaagtacttagaatataagaaccaagaccgcgttgctggtcaaaccagttggtcattctggggactcttcaaatattcattggatgggattgtaactttctcagaaacaccattagccattgcgtccttcgtcggctttttctcattcgcgattgccctgcttgcattaatcttcatcgttattcgcgctttgatttttggcgattcaacaagcggttggccatcactcatttcagttatcctaatggtcggcggtttacaactcctatgcctagggattgtcggcaaatacatcggcaaaatctacctagaagttaaaaacagaccagtgtatattgtgaaagaaaagaaataaagtgcgtttggttgcacttagcaactgagtattaagacaaaaaaacagtttgaatccgcacgtttatctcatcaaaaaaagccctcgccattatcagtcaaaatgataatggtcgagggctttttcaatgctcattatttaaacgcttctggtttttcttttgattgaccaaaatgataagcaattgcatctaaaatccgttgagatgcttgtccatccccatatggattcttggcatgggccattgcatcatacacagcttggtcatctaacagttcaaccatcgcatcatgaacttgttctggttgtgtcccaaccaacttcaacgtgcctgcttcaaccccttcagggcgttcagttgtgtcccgtaagaccaacacaggtttgcctaatgacggtgcttcttcttgcacaccaccagaatcagacatgatgaagaaactccgtgcagctaagttgtggaaatcaacaacatccaatggatcgattaaatgaatccgtgggtgattgcctaagatatcttgcgctgcttcttgcacaacagggttcaaatgcactggatagacgatttcaacatcatcatgggtttcaacaacttggcgcattaccttgaagacccgtttcattggttcaccttggttttcacgtcgatgcattgttactagaatcattcgtttgtcagcatcaacaacatccaagattgaatgattgtagtcgctttgaaccgtttgcttcaatgcatcaattgcagtattccctgtaatataaatagccttttgcggatgattttcttgtaataagttggcttcactttgactggttggtgcaaaataaagatcactgagtacatctgttaattggcgattcatttcttctgggaatggtgaatacttatcccaagttcttagtcctgcttcaacatggccaatcgctgtttgattgtagaatgcactaatgcttgctgcgaaagtagtggttgtatccccatgaaccaatacgatatccggtttttcagttgcaatcactttatcaaggttcattaatacgttactagtaatttcactaagtgtttgtcgttgtttcataacgtccaaatcgtaatctggtttaattttaaaaatttcaagcacttgatctaacatttgacgatgttgggcagttaccaccgtcacagcttcgaattcatctgcgcgttctttcaatgctaatactagcggcgccatcttaattgcttctggtcgtgtcccaaaaacagtcattactttaattttagacacaaatttgcctcctaccatttaataagttaacacctcctatattacacgttttataagggtttgccaatccattgcagtcttattcccttgagtcaaatgaataacagtctgaatataaaaaaggacgcctttttaggcgtctctttttaaaaacatcgcttcaacattcgcttgagcatcgcgtctatttctgcgtcactatagtgtaccaacttcgcattcgttaaggtcgccaaacccgtaataatgatccacgcttcgttaataatgcgttcgtgttctgactcactaaccgtttttaacggttgatagtcctgcaatctagtttgcgtcaattgccccatgaaaagttgtgcttcatccttaccaaagtggttatcaataaataacgcacggtaaagttctggttcgattgtagcaaaacgaatatagccaatcccgagattgactaaggcatcatctgttcgttgttcttcactgacataccacaccaaacgcgccttggcttgttccaaaatggcttgcttgagattggccatattaccgaattctaaatagatgggttgtgtcgaacagtctagtgccttggcaaggctgcgcgctgtaattgcttttaaaccatccgctaataccatttcgtatgctttatccagaatttgctccgctttaatccgttttgtccgtgccatcgttcccactccttaaccgatcaatccgtttttcaatattatctactgtcactctaccacaaaattaaataacatgaaaacgtttttatctgttttacgagttttttaaatcgccatgtgctatgataaacatattaaatcgcccttaaggaggaatttttgatgactactttccaacataatcttgaaaaatacgccgctttagtcgctaaaacaggaattaacgtccaacctggtgatacagtggtgctccaaatcgctgttacgcaagctgaattcgcccgtgatatgacagctgcttgttatgacctcggtgcagccgaagtgattatcaaatggcaagatgatgacatcgatcggatcaatatgcaacacaaagccgaagatcgcctcgttaacgtgccagacttccagaaacaagaatacgattactggttagcaaataacgccaaacggatttcggtgatgtcgagcaatcctgataaccttaagggcctcgatggtgatcgggtcgctgctgttcaaaaagcaaacggtcaagcaatgcttaaagttcgccaagcaacacaagccaacaaaaatagttggattgtaattgccgcagctagtcccgcttgggcaaagaaagtctttcctgatatggacgaacaagccgcaactgataagttatggacagagattttcaaaacaacccgggtagataaagaagacccaatccttgcttgggaacaacatggcaagaaactgcaagccaaagccgctgaattaaacgctgcgcaatacaaagcactccattacacagctcctggcactgatctcacaattgggttacctgaaaaccacatctggatgggtggtcctagccgtagtagtgatggtcgttcattcgtcgctaacatgcctactgaggaagttttctcagcagctgatgccaacaacgtcgatggctacatttcttctacgaaaccattgagttacgctggtaacacactcaataacatgcaatttacttttgaaaacggcaaagtggtcaaagccaccgctgaagaaggcaacgatgtcttacaaaaactcttacaaaccgatgctggggtcaagagcctaggtgaagtcgcacttgtaccagatccttcaccaatttcacaatcaaagatcaccttctacaataccttatttgacgaaaatgcttcaaaccatttggcactcggctctgcttacgccttttcaattgaaggcggcacagatatgtctgaagaggaattaaaagcagctggtttaaaccgtagtcaagcccacgttgacttcatggtcggttctagtcaaatgaacatcgatggcttaacgcacgacggtcagattgtccccattttcagaaacggtgactgggctgactaatgattacatggctcatgctccttggcgtctgcgtttgtctaaccaccttcttcattggactaaccgcctatagcgcctaccagaaacaagcgattggtggtctaatcattgtgtgcgttgccggtttagtcttaaccgcaatcacggcattcttctactaccaagcactgacacatttataattcgaaagggtcacgacaaaatttttgttgcgaccctttttgatgtgctagactgttggcatactttttgttcactatatcattattcgttagtaataatgattcgtatgtactggtataacaggttttatacaatgtttttgttgtgaacaattgctcaaaaacaattgataatccttctcaattagctataatgaagttaaatcaaccagaggagtccgccattatgaaagaattatccgccagtgcaccactcgaacatcgtttccatttatcagaacgtttgaacattatccgcgccggcgttttaggggcaaatgatggcattatctctgtagctggaatcgtagtcggtgtcgcgagcgcccaccaaagtcagtacacgatttttcttgctggtatttctggcatgcttgctggcgccttttcaatgggtggcggtgaatacgtctcggtcagcacgcaacgtgatacgcaaaaatccatgatgcggcttcaaaaagaagccatccaaaacgaatacgctgctgaagtggccagtctacaacgaacttacgaatcaaaaggcttgcccactccacttgcacatcaggtagcttcagcgttcatgcaaaaagacagtctcgacatcacgctccgcgaaaaatacaatattgaattacaccattacttcaacccgtggcatgccgccttttcatcatttttctcattcatgttaggctcattgctgccaatcatcgccatcctagcaattccatacccttacaaagtcagtggaactatcggttcaattgttcttgcccttatcgcgaccggttacacgagtgcaacgttaggcaaggcaaaccgactcaaaggtgttttgcgcaacgtcttaaccggcgtcttaaccatggtcgtcacctatttaattggtggttctatcggctaagcttcacttttaacctaaaatttgctatgctatatttaatttaatcgtcgccaccgggcagttaatcacttcattaggtcaaagaagaagtgattggctgtcctttttttgtggccgatattattaggaggttctattgtatggcatgggttgatttattgattgcaggattggcagaagtttggtgggcaacgactatgaagatgagtggtgggttcactaagctcaattacacattactgacgattgctggcatgctcgtcagcttcggttttctaattcgtgcgacgaagggattaccattgagcattgcttatccggtttggaccggaattggcgcagtgggagctattttagtcggcatcatcttattcaatgaacacatttctttattaacctggctattcgttattttattagtaatcggaattctcggcattaaaatgacgagtggtcattaaaaaataggcttacccattttgggtaagccttatttattaacgtgttctaattgccaactcgcgatagtttgaatcaactcgattggtaatgccgttacatctttttcgaattgtagtgtccctttgccggtctgatatggtgcgacagcttttgcaaaatgggccatcggttgattagtgggataaaacccaatgtgccgtttattaatgccaaaatagcaaattgctttaggttgataatacccaaccaaaccataagccagcttcatctctgcgtctggtaacactgcccgaagaatggtgtgcattgctagtgcgagtgttcgattagtatcagttgtaaggcctgcattatattgctcaataactgtcatcttatccccacctttattttgctctcattctagcatgaaaccacaaaaaaagcccaaccgaagttggactcttgaaaaacaataattatttaacagctggtgtaccgaaccattcgatacgtgattcaactgtgtctttgattgcttttgtacctggtgcaagaactttgcgaggatcgaagcctttttcagcttgatctttgttttctgcatagtattctttaacagcgtttgaccatgcgatttgttgttctgtattaacgttaacttttgagatacccatttcgattgctttaaggatttgttccttaggaatacctgaaccaccatgtaatacaagtggtaagtcaatagcgtcagctaattcttgtaaacggtcaaagcttaaaccttgccagttttcagggtatacaccatgaatgttaccaataccaactgctaagtaatcaggaccagcagctgctaattgtttagcttcttcaacgtcagctaattcgccagcaccgatgataccgtcttcttcgccaccaattgaaccaacttcggcttcaactgagatgcctttagcatgtgctaaagcaacgatttcttttgtctttgctaagttttcttcgaatggtaaatcatgaccatcgaacataactgagttgtaaccaacttcgatacattctttagcagcttcgtagttaccgtgatctaaatgcatgacaacaggaactgtgatgttcattgacttgattgtttgttcaaccaagttcttgcataattcgtaaccacccatatatttagcagcacccattgatgtttggatcaagattggtgtgttagtttcttgagcagcacctaagatagcacgtgtccattcaaggttgtttgtgttgaaagcaccaacagcgtaatgaccttcacgagcagctttaaagatttctgtaccattaactaatgacatgaaaaagcctccagattaattgcaacttttgcgttgcgatttttgaatacgaatctattttaacatattttcacctaatataaatcataaatccgtaactttctgaaagtgaaagcgtaatcattccgcttgattattttacgccaattaaaaagcacactagttaatctagtgtgcttttacgacaattgcttcaaagtgcgcccggcgagaatcgaactcgcaacctatcgcttaggaggcgattgctctatccagttgagccacgagcgcctatgagtcatattgtcgcatctgttgttttaattgtaaagttgattttaataaatctttattcatccgttaaaacggcgttcatcgtttcttgacctaaaaagaacacggcaccagccgctaatagtatcgcacccgtaaaaagtgtaaaaatcacggctactgataccccctgctgaattagcgcaccaactaaaaatggcccaaccacaccgccaattcgcccgatgccagctgctaaaccactcccacttccacggacaagtgcaggatattgttctggagtataagcatatagcgccccccatgcaccaagattgaaaaaagataacagcgcaccggccacgagtaacatggcaactgagtttgcattgccaaacaataatgcactgagtgctgttccgattagaaagccacctaaaacacgtttccgccccccatttttcaatcaaccatgctgctacaaagtagcctggtaattgtgccaaggtcataatcagcacatattcaaaacttttaaccaagctgaacccttttaagaccatcacactggggagccataaaaacatcccatagtatgaaaagaccactaaaaaccatacgagccataacataattgttctttggcgatacgctggttcaaataaaacacgcaatcgttgcatgaatggtaccttacggttaatcgtcgtcggttcatgctcttgtttaacatgtttccgtaacacaagtgtgtagatggcgggcaatgacgtgatcaataagaccactcgccagccccaaactggaatgacaaaataggcgagtaaactggcaactaaccacccggctgcccagaaactttctaacaatacgacagcccgaccgcgcgatgccgttggcgtattctccgagattaatgtcgaggctaccggtagctcgccacccaacccagcaccgaccaataaccggagtactagaaaaagactcaacgatgtactaaaggcagatatcccattgccaatcgaaaatactaataaggaacaaagtaaactgttttttcgaccaattttatcagctaaaatgccgaaaataacggcgccaaaaaccattccaattgaactgacactcccaattaatcccatttgtgcgctactgagttgccactctttggcaagcgcagcaatcacaaacgatagcatccccacatccattgcatcgaacaaccatgcaccacctgcagcccataaaagtgtcctatgttcttttgtcatcccgcattactcccttatgttatgaatggtcctatcatacaaaaagagtttacatgtgtcaagacacctaattatgcattataataaatatttatctgtttaagcgctgcgacaatttgcttaaatcgttgttctgacgcgcattcaatcgtgtgtaaatgaatgccgttggttaatgttgaaagtaatttctgatggggcattgtggccattttttgcataaagcctttgacatctgtcaaggtgccgattcccagttgaccggtcagttcaccatacaatggatgatcaacggtcacgtcgatcatgcgccccccattttcaacaatcgttgtcaattcgagttcagtctgcccctgattatgctgacaggcaacttgtgcctgatatggcattgtttgttgcgtctgcgtttggtcgtaataaccgctaactgtcgcaataatttgggccccttgtgcgcgaagtaaggcgatatccccaacaattgtctgccggctaactttatattgttgcgctaatactttggcactgatgggttgcgcactcttttgaattgcattcagaattgctgtacgtcgttcttgcgttgtcatattgccacctcgtcttgatttcttacgctatattctaagcgttctaaaggcaaaaagaaagtggagggttgaaacgaactcgtttttccggataacctaaaaatacatattatggcttaaacccgccataatatgtatttttctgttaatcctcaaagccaatccgttcgactgcgcactctatagtatttccccgttgcttttaatgactttttggtaccagtagaaactgtcttttggatagcggtttagttctctttcttctgtttcgtcgcgatccacgtagacgaagccatagcgtttttgatagccgtttgtccaacttaataaatctgtgaagctccatgtcgtgtaaccgatgaccgaaacgccatcggtaatagcttcgtggatggcttgaacgtgcgcctttaaaaaggcaatccggtagtcgtcgtgcacttgcccgccttctttcaaggtgtcataagcccctaaaccgttctcagtaattaagaccggcagtccataacggctctcaatacgtctgagtgcgattcgaagtccttcggggtcaatattccaatcccagtcagtttgttgcatataggggttatcagcggtcttgtagacgcctggcaacccacttgcttggctagtgccctttttaccggaagtattttgcttggtcaaaccaacgccaccttctagtgggttagtcgtaactgtcatcgtctgatagtaattcaaccccataaaatcgggatgtgcgagtggatcggctaataaagcttggtccgcttcagtaatttcgggtgcaatcccgtttcgctcgagataagtcatcactaatttcggataacggccccaagcataaacgtccatccacaaatcagcgttaatttgttcggcattatcagccgcaatttgattttctgggtccgcattcagcgcataagttgggctgtaggcaaaactaggtccgatgcccccttgatagcctttttcatggaataatttaatcgcactagcattggcaaggtttgccatatgattagcttgataagttcgcttagcatcagtcactgctggcggatgctccgctgttaaatagccgtgagtgatgaagacattttgttcgttcaaggtaacccaatgttgcacacgatcgccgaaacgttcgaacaataagcctgcgtagttggtaaaatcttcaataatttgacgcgattcccaaccgccatattcggtttgcaacgcttgcggtaagtcccaatgataaatcgtcacgattggttcaatatcattggcaattaatgtattaattaaacgatcataaaaggctaagcccgcctcattcacagcacctttaccatttggtaagacccgtggccatgaaatcgaaaaacgataggctttgagcccagcgcgtgccattagcgccacgtcttcttcgaaacggtgatagtgatccaccgctacatcaccattcgtggctttgaacgttttgcctggaatgcggacaaattcatcccacacagaacggcccttaccatcttcttggtaggccccttcaatttgataggccgcagaagctgaaccccacaaaaaatctttaggaaatggtgctaattgatggtattccattactggtcatcctactttctctcaaagtcattgcttattattctgcttgatatgctttttcgatttgtttcaacattttcttaaagccgcgtttacgcatgaaacccatgacaaaggccatcaacatatcattggtttgttgtaatttaccatttgctttggcattttcgcgatagataacttcaatagactgcggtccattcgcgaaaatatcgtaacttgattgatagctcccccgggtagaagtcgtttcgtagtgataactctgatctttaatcagttgcgtaatcttcaatgtcgcccgattcttgccaaattgcttgtcgtacgaataattaggcaactgcgcttcagttagtttatccccagtttgttgcttaatatcaaacaacactgattccagaatcttctgataaaaataactagctggcatttttaaatttaatttaatttccatcccgttcccactattctcttcaatgtgccatttgttgcttttaactaaaaagggctcgaacaaaagtcattttgtcttagcccttttgttcattagccaaactttaatcgactggtacaccggccatcttcttgtaaacgtcaacgacttcgcctgctaaatcgcggaaagtaattgcgttcatcaagtgatcttgtgagtgaaccgtcaataatgtcacttgcatgtgatcgccacttgcttctttggttaacatatctgtttgtgaattatgggcttctgataaagcggcatccgcttctgcaagtttggcagctgctgtttcgaagtcacctttcttagcggccatgattgcttccattgagctactcttggcgttcccaccgttgataattaatcccatgattgcttctaagttctgttcttctgccatagtatggcacctcctatgatcatctcatcgtgaaccactttcgtaaccattcattaattggtctagatatttcttcgagaatgactaaccaatccattaaaaggctttcaaaaattagttcctgattgtgagagttcgccactatcgcattttacgaagcgaaagaaaacccttacttatattgtaatcgcttcctgagatttgtcaattaattactgataaccttttcacaaacggactagtccaaaaaaaagaaaccttaacaggttgttaaggtttctcgctcaatctggattagaccactagtcattatttttcttatggtaacccttattcttttgatttcgtttacggtttttcttatgttttggttttaatggtgcagctggctgttggcgaactggtactactttggctttgcgcgcgcttgtcgtcggcgtagccttttgtacttgtccttctgttgcttcaccagtggttggtacagcagatgttgctttcgttgcagcaactggtgctactttaggcgtcactggtttttcggcttccaaatgatcaccgaccaaataacgggtcacaagatcatattcaggcgccaataacttacgcaaattccgcccatcgtgttgattgcccaacgtcaaaacagtcccggtgcgtcccatccgaccagtccgaccagcacgatgaatgtaagtgatttttgcgtttggtacatcaaaattaatcacataaggtaagtcggtgatatccaagccacggccagccacgtccgttgctagtaagagttgaatcttaccttcacggaaatctttgagcgctttttggcgttctgtttggcgaccttgccctgagagtgcggcatacgttactttttgatgttttaacgtttgtgcagcttgtaagagttgcgcggattggttaaaaatgaccaatcctctaaaattcttttgatgtgctaaatggcgtaagacgttcactttttgagcgttaccagttgggataaatgcatgcaacacttccccacccgtcttatcaatcccacgcacgtcgattgtttcgattggcacgccgaaccatgtttccaactctaataagatatcggttgatgtcgctgaaaagaagccaagttgcacatcggcaggtgattcttgcacgatatggcgggtttctgaaagcccgctatccgtcaataattcgtcggcttcgtccataataatcgcttggagtgtatggaatttcactttccgttgttcgctcaattctaataaccgaccagtcgttgccacgataatctctggtttggccttaagccgttcgatttggcgtttaatattcgccttccccgtaatcgcttggacattacagtcgattgccttggcataaggttgaatgacgtcccgtgtttggatcaccaattcctgtgaaggagccaaaattaagacttgtagcccttcgcccggcataattttttctaataacggtaatgaaaacgcgagggttttcccagaacccgtgggtgccagtcctagaattgattggtcttttttcagtggttgataaactgcctcttggatgggtgacatttctgtaaatccttgttcatcccatagtgcttgaaatagtggtgaaacgctcatgtattgcctccgtcatgttaatctgcatcaaatgttattccggccgactgtcttaattgatataaaacttggttgaccgattcacttagctgtaataatttatgataccgttttgtgtcacgattagcaatcatcgccgcgaaattttctgcctcagcaaccattggattagcaagtgattgttcccctagtgactcaatcttttgcccaccttcgctgtagcggtcaacactgccgattgtgccggcattatcgaggacaatcgtcgtttggccaccataaatttcagacgttagataggaatcaacggttttgccaaaaatcaacgtgacgttaaaggttggataacgcagtgttgcgacccctttaccatccactccagttggtaacaattcagcttgataatcgactgaatcgggcacaccaaaccagctgacggcatcatagacgacatacacgccgagatcttgtaaagctcctccagaaaaatgtggtgagaaaatattcggttcttcacccgctaaaacagcgtcatagcgtgatgaatatttcatatagctcaaggtcgcgccattgatcgccggtaatgcgttgatggcttgttgtacaatcttaaagttggcctcatgaatatgacgtgctgcttcgaataagaattggtctggatgttgctttaataatgcttgcatggctgccatttcagccggattactgaaggcaggtttttccacgatgacatttttacccgctaaaattgcttgcttcgcttgttcaaagtgcagactattaggtgatgcaatgtagacggtttcaaattcattggcattcataaacccgtctaagtcagtgtaacttgtggcttctggtgcgtgatacttcgttttaaattggtcggctttatctgccgtccgtgaataaacagctgttaacttaaatgattcagattcccgggccgcatcaacaaattgtcccgtaatccagttagtcccaataatcccaagtgtttgcattataatcagctcccttatttaatactgccagtatacgggatttagatctagaagcctatcgaaaagtttttctactgataagaattccgccactattcacttctttaaccattccttaaaaaaacagtcgtgagtccgataattaattgtccgcaaactaactatttcgtggtagaataatagtaagttggggtgtgacttatgcgattttttaaatttcaaaaaccacaagcaattttaaatcaaaccattcaccagtatcagcaaaaagttcggacggctcaagcgagtaaagtagcgactttttatgctggacactggtcttttaatgacaaccaaacccgaaaaaaacacacattagaaattacaccgaacttgttggtgcaaatcgaccataagccattgagtggtcaagtcatctccctcacggaaaacgaattggtctttctcgatcactacggctatcaattaaaaattacttgtgaaaatcaacggcccgtttcaatttacgatgaagccgaagatatggattatccaatcgaatagctattaaaaaaggcccataatgctcagcgttatgggcctttttagttattctttatttgttcaacattttttgagctttatctgggacttcgtttttggcaaccttttcccatgaaaccacacccttatttttattgacgattaatttgaggtacgcatttcgtttaagcggcgttgatttattaccattaaaatcaacttttttggtaacaccatcttcattgtaggctgcttgttgatagttataatcgataaccgtttcccctgctgaatccttttcttccattcgtgttccgtttgaaacaatctgtgtatagtaggcttccccaccgtaataatagctatgaattccccaactaccaccgatgaaaaccaccacgattgcgattaataataaccagcctttgtgtttaatcattattttctctccgtttctatttaatagtctgccattgttgcttggtgccagtaaaaactgctaactgatagttcgtctgattatcactgtttggaatctgactagccattgtgtattgccagaacccgttcttagtcgccaatgttggctgttcccgcgtagtttgccacaatggatagtctcctttgtgtggcacataccgttttaataagctgggtgcaccaccaatgagacaattttgatgataatgttgattaatcaaggtcactagctgcgccagtgccatttgcgttttcttttgtgcgggcggttgttgtgcatagtcgttataataatccaaatagatcataattggtaaatcacccgtctggctgccaactgctttaaaaagttggtcagcttggcgttcaggcgaactatcaaaactaaaaaaatgaaagatgcccacgcgtaagccagtgccacttgctcgactgtaattggtgtcgaaattatcatccttgtaactggccccttcagttgcttttaaataaacaaactgaataccgtccttttttaacccgtcaaaatcttggtaaccatctgactgacttaattgcatccctagaatcggatattgcgtcgcgcttggtcgatccgaacggtgtttcaaccaccagatagcaccaccaagacacagagctaccgcgataatgccgataattatttgtcgccaatagcgcttttggaaactgtcttgaaaaatcggtgtcacttttcgtctcatccacggttcctccatttccagccttagtacgcttagtttactatcttcatgcattcgagacaagccacctaacaattttgttcgttactgtcacttagagttgccttttattggtaatcagatacaatgtgaacaaagggaggcggaatatgttagatgaacgcttagtggggttaacgtttactttacaggatgctaaatcaaccggcaccgttaatttttttggcatcttatatcattaccgtgtcgaaggaccagctagcgctggcttactcgtcatggtaacggccgtcacacctttagctttaatcgtgacagcgcaccacaatattctggcgtattaaaccagacaaaagggagtttttattatgggtattttcatcagtattttagtcattcttgttttagttattgttgcagtcaccctcttttcatcatttgccttgattcataccggggaagttgggattttggaacgcttaggggtctacgttaaaacgcttgatcctggtttccatttggtcattccattcatttatcacatcacagaaatcgttaatatgaaacaaatccccttaaaagtcgctgaacaagaagtcattaccaaagacaacgtggttgttatgatttcggaaacgattaaatatcacatcactgacgtcaatgcgtacgtttataaaaataaagattccgttctaagtatggtccaagacacccgtgcacaattacgtgggattattgggaacatggacttgaacgatgttttaaatggcaccgaaaaaattaaccaaaccctttttgaacaacttagcgaagtaacagccggctacggcttaaacgttgatcgggtcaatatcgattcaattcaagtggcccacgacatccaagaatcaatgaataaattgctccgtgcttcgcgtgaaaaagaagccaacattatggaagccgaagggctcaaagccgccgcaatccgtaaagctgaagggttaaaagaagcgaatattctagaagccgaagccaataaacaaacacaaattttggaagctgaagggaaagctcaaagtgaacgaacaattgccgaagctgttaaagatcaaattaatttgatcaacgccagcttagtcaataacggcgaactctatcttcaatataagaatattgaagcgatggaacacatcgcagacggtcaaaataacaccattgtcttgccaaataagtcaatcgatagcttgggtaatttgccagcaattggtgctctagttcaaaaagaaagtaccaagcattctaattaatgagtgccaataaaaaaggccccagaataacaaccttactgctattctggggctttttttattggtcttctgaaggtgttgaatccttaggtgttggttgtgtattgcgggtgttctttttgctgagaatgtactgttccaacaaggccacaatctgttgattctgtggtagatcagagtgttgtgcttggtcacctgtcaccgtaatttcggtgtagtgcttgacttgtccttgataaatgtactttcccgcctctacactacgcgcgggtacaatcccatcattttcaaagttttccgttcccgcaattgaatacatcgataagttcgtcggaatatttttacgtttcttaatgaaatccgtcagcatctgtgacttatgcgtaatcgacgtttcggaaaagttatacggcgaaccaatcgtcatcaacttcttcactgtaatatcatcgcgattaaaataatcttctaaaaaagctgtataaattaagccaccattggaatggccaaccgctttaaagttattaaattgatacttcttagtcaacgcggtaaacgcgagcgaaaaccatttagcttgcttttgaatattactgtaaccgtccttattattttcaaaaccaaccacgataaacggttcattatcccgcggtttaatttcccctgaatagctaatctgattattttcatgcacagttagttttaacaagctgtgccgattcccgcggttagcgttcaatttagccactaattcatcaaaccgattttgggttgcactactccctggaataaaaattaccggtgacattcgtgaatcatggcgcttagctaaggtcataacgctctggcgactccattgagcagctggccacattaatccgccgattaaggccaaactaatgactaacaaccagaggcttttttttcttaatttggccaatttatgccgcctcctttacaagtgctaattgatctgccaattggacaaacggcttgtagatcatcacgccgacgacaacgtttaataccgtcaccgccagcgcgactaaattaccgttggtgcccatgaacgcttgcaataagccgggggtcccaagtggaaccgtgaagactaccgatggcatgagattcaatgcaactgctgccgatgcaatccccatgtttaccagtggtaccaataagaatggaatcacatacaagccatttccaatgacaggcattcccacaaggaccgcgctattaaagttaaataaaacgggcaacaacgaccatcgaccaatcaaatgataatccctttgtttgctgaagatgaaaacggcaatcactaaggctaatgtcccacccgtcccgccaatcgcaccaaagggttcatacaaagtccctaacgtgaacggatatggaacgtgccaagccgtgtgatgactaaacgcatagtttaagttggccgaagatgcgattccctcacgcccaaattgggccaatgttggcatactcgttaatccaaaaaaagttaagctagtggccgctaaaccagtccccaacgtgaaaagcagacccgtttgatttgcttttagtgattgtaatcgtaagatgacttgatctggcaagattgaaatcgccaaccaatttagcaggacactcagccctaaaatgacgccgagcaccaataaaatcgcccacatagaatccaatgaacgtcctactgctgacccattcagcggtaaatcacgccgatgaggtcgtcctaattttttgaaggctaatccagtcagatagccgactaataggccaaaaaataagccccccattcccaacatctggctattgaaagataagccctcatttggcgtcaaccgtaacgctaagattaaataggcaataagccccgtaatgctggctaattgttcatcacgcttatagtgtttggctgtatagcgcgccgcacacatcgctgctaatgccgcaacgattcctaacgtcaaactcgtaatgctgtcaaacatcatctgaaagatattccgtttactcaaccaattcgaaagatgaaatacattcacaacaaaactattccggttaaaaagtgctagctggatgagttggctgatactcccaatcaagacaaatggaaataacaacgttaaacttcgctgcataatctgatagaccgccgcggattggaatcggttaaaatgttgcgctaagcgcatcattatagattgttttttgacattcatgcgttaaccctctaaacatgttttgataatttcattctagccgaccttccgcttaaatgcacgtctgaacgcaaaaaacgggtcgctactttccatctctggataataacgacccgctaaaacgtgcgccataaaccatcttcttctggttagctacgtctgtcaaatcaccaacttgttggttattcgccagcctaggctatactcagaagttaaccgccacaaacgcactctattttgaaacgtgctttttgtggcaacttcttccgtctagctacgtctgtcaaatcaccaacttgttggttattcgccagcctaggctatactcagaagttaaccgccacaaacgcactttattttaatactaatttagtgacactttcgacgtgtagcgtttgtgggaacatgtcgactggttgtgtgctttctgcttggtagccttgggctgccaatagttctaaatcacgcgccaatgttgctggattacagctgacatagaccatcttggctggttttaattgaccaacggcttcgatgaagctagcttccaaccctttacgtggtgggtcaacaatcaaagcatcgacttttaagtcatctgcttgccattgcgccatcacttcttcggctttaccgagtgtaaattcaacgttttcgatgccgttaatcttggcattgtgccgcgcatccataacagctgattcaacaacttcaacaccgtaaacttgcttagcatgtttagcgactgctaatgaaatcgtcccaatccctgaataagcatcaatgactgtttcgttccccgttaattcagcagcttcgatcgccttgttatacaagacttccgtttgcactgggttcacttggtagaatgactgtgctgaaatttcgaacttcaagcccattaattcatcacgaataaagtcgcggccagcgattaattttgtttcgtcaccaaagatgacgttcgtttgagcagcattgacgttttgcatgatgctgaccacttctggtaaagcttttttgatttcaacggcgatttcacgggcagccggtaatttcttactccgcgtgatgaagacaatcatcatttcgtggctgtaataaccgcggcgaaccataatggtcttcaaaacacccttatgcgtatcttcgttgtatggatcaatgtagaaacgacgcaagatatcacgaatgaccttgatagcttcatcaatcttaggatcttgaatgtagaagtcttccattggcatcacttgatgactgtgtttccggtagaaaccagttgttaaagcaccatcgataaaccgaacaggaacttgtgccttgttccggtaacctgttggatcatccatccctaaaacaggttgcactggaatatctaaatgggctttttggaagacgttcaagacttggttacgcttgaaatctaattgggctgggtatgccaagtgttgtaatggcgcaatcccagtttgtgagtaaatgttagcttttgattcaacgcggtctgggcttttcttcaataaattaactaagcgcgcaaaaccatattgtttattgacctttgtgacttggatttcagcttgttcatcgggcaaaacgccttcgataaacaacggatagttgtcgactttagcgacacccatgccttcataggttaaatccataatatcaaccgtcaatgtttcattttttcttacaggtgcttgtattttcatagttacctctttttaattgtgtaaaaagagtctgagacaaaactgagttttgcttcggactcttttcttagctacaagtgtgcggtcaatccgctcacgttatccaatgttccagtttaacctattttaccatcgccgtctatgtcttcttcagaaatcgcttcgacttcctttacgaataaatcttcggcagactgctgagtaggtgtttctgatgtaatagcgtgatctggaatatcttccttattcacatacatctcgatatgttgttgcaagttggtaaaggtcattggtgcatcgccaccgtattcgccatctaaattaatcatcatcttaacgtcatcatcaccaggacgcgcaactagttttgacgtcttggtataaatgacccgtggatcattaacgtgtttgccacctttaatgacgagtgcgattaaatggactaattcggccatgttggctgtcttaaccacaatcaatgagaaattaccatcattcagttgtgcatccggcgcaatctgttcaaatccaccaactgaactggttaaaccgagtaagaatagggaagcttccccatcatacgtaccttcatcatattccagatgcatcttaatcggtttaatttggggtaacatctcagcaccttttacgacatacgcgagatagccaaaaattgacttaaagtctgaggggacttcataggtcaattcggttagcaaaccaccaccagcaatgttcatgaagtaattgtcattggcttgaccgatatccatcttaagcgtttggttcttcaaaatcacgcgggctgcttcaaccggattatcacgcggaatcttcaaagcccgagcataatcgtttgttgtcccagccggaatgacggccatcattgggcgtttttccaagccggcaatgccgttgacgacttcattaattgtcccatcaccgccagcggcaacgattaaatcgaagtccgcctttgctgctcttgtggcctctttttgcgctgaagcttcttcaggcgttgtttgaaaagcactcgcttcataacccgcttgttctaaaatatccagaatatcagcgacactacgtttcatcacttcatgtcctgaagttggattataaattaaccgtgcacgtttttgcattcgaatctcctaaaatatcaattatcgtttgttcaattcggccatcaacaagtcattgacaactttcggattagcttgaccccgtgtttccttcataatcttaccgactaagaacccaactgcgcggtctttaccgttcttgaaatcgtcaattgattgttggttgtcatctaaaatacctgtgatgattggtgtcaacttagcagggtctgataattggaccatgcctttagcttcaacccaggcttttggatccgtgtcattttggataatttcttggaagactttcttagcaatcttcgatgaaataatcccgtctttaattaaattgatcatttgggctaagtgggcaggtgtgagggctgtttcttgaaggtcaatttgtttgtcgttcaagtaagcattcacttcacccatcaaccagttagaaacttgttttggtgcggcgccatcagcaacagctgcttcaaagaagtcagacatttccttggtgttcgtcaagacacccgcatcgtattcaggcaagcccaattcatccacatagcgtgcacgccgtttagccggcatttcaggcatattgtcttgaacttcttgtaaccaatcatcaccaatgtgtaatggtggtagatctggttctgggaaataacgatagtcatccgcaccggtcttaacccgcataaggaatgtttcgcccgttttttcgtcaaaacgacgggtttcagggcgcactgtttcgccagcaatcaaaagttgtgattgacgcttgatttcataagctaaccccaaacggacgtgattaaaggagttcaagttcttcaattctgatttcacaccatattgcttcgcaccgattggtcgcacagaaatgttagtatctacccgcattgagccttcttccatcttaacgtcagatgcgccagtaaattgaacaatttggcgtaacgtttcaaggtaagcataggcttcttcaggcgttgacatatcaggttttgaaacaatttcaatcaaggcagtcccttgacggtttaaatcgacatatgaatagccgtctgaaccatgggtattcttcccggcatcttcttcaacgtgcaattcagcaatcccgatttgctttgtatggccatcgacttcgacttcgatatagccatctttaccaaggggttgttcgtattgtgtgatttggtaagcttttggattatctggatagaagtaattcttccggtcgaaatgcgtatcgcgcgcaatatcagcgtgcaaggcagtcgcaaccatcatcccaagtgtgtatgcccctttattcaaggttggcaatgtcccaggataaccccagtcaatcacattcgtgttagtattcggttctgcaccatagtttacaggagatggactgtacatttttgaattggtttttaattcaatatgcacttcaagtccgattgttgtttcgaaattcattaggcttttcctcctttgaagcttggaacgttcttgttaaattgagttgcttgttcaaaggcataacctgcgcgataaacagattcttcatcaaatgctttcccaataatttgtaaaccaactggcatgccatctactaagccggcaggcactgacattgctggtaagccagccatgttagcaggaattgttaagatatcgttcatatacattgtcactggatctgatactttgcgacccaagtcaaaagcggtggttggtgttgttggtccaaccactaagtcgtagtctgcgaaaactttttcaaagtcgcgcacgattaatgtccgcacttgaccagccttcttgaagtaagcatcgtaaaagcctgatgaaagggcaaacgttcctaacataatccgccgtttcacttcatcaccgaaaccttcagaacgtgatttaacatacacatcttcaagtgtcttggcttcaggtgaacgataaccataacgaatcccgtcaaaacgtgacaagttagatgaagcttcacttgaagccataatgtagtaagtttggacggcatacttagaatttggcaagctgacttcgtcaacggttgcccctaatgatttcaaagtttcaatggctgtttcgatttgggctttaacgcctggttcgacaccttctgccatgtattctttggcaacagcaatcttcatgcctttgatgtcaccatttaaagcggcacggaaatcaggcactgggatatcagcactcgtactatctttttcatcatgaccactgatggcttgtaaaacagtcgcattatcagcaactgtccgactaaagaccccaacttgatcaagacttgaagcaaaagcgatcgcaccccagcgtgacacacgaccgtatgttggtttgatgccgacaatcccattaaatgcagctggttggcgaattgagccacccgtatctgtccctaaagaagcaacgacttcaccggccgcaactgctgctgcagaaccacctgatgaaccaccaggtactttgtctaagttccaagggttctttgtcttcttgaaggctgatgtttctgttgatgaacccattgcgaattcatccatgttgtttttaccgatcacaattgcatctttagcttttaatttttcaacaaccgttgcatcaaaaaccggcgtgaaattttcaagcatcttgctggcagcagtggtcgttaagccatccgttaataagttatctttaatcccgattggcatcccagctaataagttatctgcatcaattggttgggcgtccactttggcagccgcagcttgtgcaccagcttcatcgattgctaaaaaagcatcaacttgtggttctctcttgtcaatttcagcaactgtttcagttaccaattggctagcagttaagtcaccagccactaatttggcatggatactttgtaaatcttcatataagtagttcacggctagtcttcctccttatccataatggcagggactttcaataagccgtccgctgaatctggtgcattcttcattaaaatctcgcgatctgtgccagcttgagccacatcttcgcggacaatattttgaaggttattcacgtgggtcgtcactgggacacccgttgtatcaactttatttaattcatcagtcattttcatgatgtctgcaagttgttcagtaaattgttctaactcagcatcgctaaaagctagttttgaaagttctgcgacatgctgaacttgtgttttattaatcatgagtaaacccctcttctaattctgtcacttttatccattctgattaattttaccatatattaacgtataagaaagtgacatcccttggaatttaccagtttttcctaatctttaccggtttcagcagatattgaaatatatttttactttctttttaaaagcgtaattgaatgttatgcaattcattagaaggcgatatgatttataagagtttatcatagaaacgcattcgtttaatcttatatactgaatacagataagaagttgtgaataatgtacaagattatcattaacttatagatgagtgttataatatgaaaatcaatatctcggaacaccttgtagcagtagcagttttaagtttaatgggtggcattgtcttacaaagtacgaccgtttcagcagcgaccacttcggttggtgtaactatcactggtgtaacacctggaatggccgctaaagccaaagaagcagccgcagaacaagccgctttagaagaagcatggtttacaaacagaaatcgatgacagcgaacctgtagaagttaccgaaacaattggcggtcaaacaactcactactgggaatcagcagatggctcacgaagcacaactgcccccgcagaagttcaagacgaaacagtagccgcaccggaagtagcacctgaacaatttgaagaaacagcagttgaagaagaccaaccagccgaaaacttcaaaccaatgcctaagaaacatgacatcgatcaaaaagcagttgctttcaaacaactcacaacagattgggctagcaatcaaatcatgtcatcattggaagacttaatcactaaggctttccaacttaacaaataacactcagtattagctaagcggcaagtatcgtaaccaagcgtccccagttttgagtagtttcaaaagcaacactcaatagtctgtcggtgtaacttacggatttacccatactagaagttactaaactatttagaattgtttttttcctattttaaacgtttataaccactccactgctaaaataatttcattaaagtttgatgcgttcacccaaaattttgggtgaatttttttattgcttaatgatttttcaaaaataagtctaattttaatagacatttcacaacttatttcatgctcataaaagaacccaaacctactgatagaagcaacttaattgattatcgggctgtattatcggtatccagtctgaactcccttcatgtaattttcatttacggcagactctggctagcctgattacagcagaacacctcaataggtgttatactcttaataacatctttttaaaaggagtctatcatgaaaaaatcagtccgtttaagcaatgccgtccacctgatgaccctgattgctttaaacccgtttgataacctttctagtcaacgcattgctaaaagcatcaatactaacccctcttttattcgccaaatcatgggacaacttaagacagctggcctattgacgagcgttaagggccatgccgaacccaaactaacgaaagctcctgaccaaatttcgctctgtgatatctataaagccgtcgatgatacccggttattgaacatcgatacccaaattgatcctagttgcggccccggacaaaatattcaattatcgcttgctacctattacgatcaaatccaagaaactgctgaacagcaaatgcaagccatcaaactagccgacattatcgaacaatatcaacaacgtctcgttgaaaatccagaattaaaactttacgaaaactaacacacaaaaaggttgggcaaattgcccaacctttttgtgtgttaatcctcagcggatatccggctgatgccgcactcttttagatttgctagtacctttactaagtcatacttaactgcaataccgcggtccattaattcacgtggcacaatcgcatctttgggattaacggtgatatatgttgcttgtggattttggtacgtcagattcataaacggttccttaataaacatcggtgtcatcatacccacacctagttctaaatagaccgtttttttaccttcagctttttgaataaattgacgatactttgcgtattgcttgttgtagtgttgtccttcaaggaattcataaccacggacccattccaacatttcagcaccacatttagggcaccgcggaattaagttttcgggtaaatggccattttcaatttgcggaaataattgatcaacaactgtctgattaggatagacttgatcatgacatttatcggcacattgaaaataggaccagtcaccctgaatcgtggcgacatctttatctggaaaagctttcgagaattgcacgtcttgattcgtcgttatcaaatcatagtctctatcctttaaaatggctttcaagtcctgatacggttggtaaactggttcatgtaaaacaaaatgaattaaagacagcttaaagccccataaatcgccgggattgtaccaatcgggaccagccgcagccgacatgccggctgcggctcccacgatgacgtaatctgcctctttgagcgtcgttgccattttttgtagtgttgcttgatagtctaaattagtcatttttgaggagctccttaaaattatcatcgattgatccagcaaggccgattgaccgttgttcaatggctgcgggaatattgatttcgtgcggtaaattcaacgtgatgtaacggtaacttagactttgcgccaccaattgcatgaggagcgccttaattaactgattattagcaccaattcctaattccagaatcaccacgttttgtgaacgatacttttgaacaaatgcgttaaacttagcttgttgcttttgaatcatcggcattggattttgattgttaccaaaattaccttccacttcaaaaatccgttcttcgtcaaatccactcagttgaaaatgcatgttgccatttgatgtgacaacaaagtattcatgaccgcccaccaactgctttaaatcgcgaaagacaggtgtactttcatagtgatcaaccatataatcgaacaatactttgtaaaatgcatctctttcagccactgttggatagttgtaaaaagccccttgaagaatattcataatcccgtagcgttcataaaaagtcccaaagtgggtcataaacgcttcgtcgtgtgcaaaaatattgtaaccttccgtaattgatagcccattaccagcactaataatgacggcatccgcattgtctagccaattccgtgctgttttaaactcgttcatgatgctctcctttggtgtaataaataaaataacaacaatatcgcatattgtacactgttatttttaaaattacaaccactgacttttaaaggtccaaaaaaatagcgtcgacaactgcgttagttgtcgacgctatttttttgcctatcagtcataactgactgttgtcgcactctttaattaataactcccgaatacgtgggttgagaaccctttactgccggctgctcggcctacgtaagcttgcatcccctctgcagacgagattgaaatatctaatggaatattttgtggtaaatatttatcagcagcggttgcaatgtattgtgtgaaactcatgatttctgtttcactgtagaattgtgtattaacggtgatgttcatcccagccaatacaccatcttcatagtgtgcttgagccgtgacaccactcaagttcgggaagaaggtttggacttgttctttaaaactagtaaacgcgtccgcatcactttgattgaccgctttttcaccattaacgagtgggaaaacttggttggcttggttcattttgtgccatgaatcaatcgttgtactaccgtttttgctgaccccataagcgaagaaggttccgcccactaaactatccttaggtgcttgtttgtaaagccccaccacgatggttgtcttactcaaaccttttttctgccgtaaacgcgttaagaccttattggccatttgtttaccttgttgcgccatcatggcactagaaattttggtttcaaaagtagcaccatattgttccttggtatagtaatccacttgattcatcccaagaccaatactcatcccttcaagcgcaccatctgcccctaagaagtcttgttctaagatttgttggagatacagtggattccgcttatccggttctttttcaccattatcttctggattcaagccaagtgtattatcttttgattgacgtgccaaccatttttgcgcttccgccgttttgatggtttgaccttcttggtagaggtatttatcagtagggaattgttttttagaaatgtttaataagccactttccaaactcttcacatcaaatgccgtgttactttgttgtgtggttaatccacgtgtctgacttgtcttgtattggttattatcaataaccccttcatacatgctgtcagtcactttcccggtcgtttgtagctttttagtcgacttagttgatgatgacaaactcgaattgctttgtaaacttgtacaacctgccaacaataaaaccgttgcggctgcaactacccataatttatactttgccactgaaaatggcctccttataagtcctaattgattcgcttattgcgccaaataactatctaggtctgcttcgttgataattggaatctccaatgcttgcgccttggttaatttactgccggcatcttctccagcaatcaaaatatctgtttttttcgaaactgagccggtcactttagcgccattatcttcaagttgttgtttcaactcaccgcgggtatattgcgatagtttaccggtcaagacaaccgtttttccgttaaagtaactatcactattttcagcttgtgcctttgtcaccccagtataggtcaggttgacttgcacttcagccaattcacgaattaaagtttgtacttgatcatcagcaaaataagtcgctaagctatccgcaatcgtctcgccaatcgtatcaaccgacataatttcttcttgatcactgcccagcaaagcctccatcgtcaagaaatgttccgctaataatcgggctgctttggcaccaacatggcgaatccctaatccaaataataacctttctagcgaattctggcgactagcttcaattgcatttaacaaattattaatagatttttctttaaacttatccagttgcgcaagttgatcggccgttaagcggtataaatcggcaacatcatggaccaatccttgatccaataattgggcaataatccgtggacctaagccgtcaatattcatcgcatttctggaagcaaaatgcgttaactgttccttcacttgtgccggacacattgggttaatacaccgcaatgcaacttcttcatccaaatgaaccaattcatgaccacacgaaggacattctgtcggaatcacatacggttgactgtcagccggccgtttagccagtactacttgtgaaatttctggaatgatgtcgcccgctttgtgtaataaaaccgtgtccaacaaacggacatctttatcacgtaacatatcagcgttatgcaatgaggcgcgcgcgactgttgtaccagccaactggacaggatccatcacagcggttggcgtgacaacccctgtccgaccaattgtccattcgatgtcacgaacaatggttgccgcttcttcaggcgggaatttataagcaatctcccaccgtggcactttaaccgtattaccgagttggcgttgtaaagctaagtcgttaacttttaacacaaccccatcgatgccgtattctaagtcatcccgcgttgcttgatagcgctcgataaaggtctttacctctgtcatattatgacaaacttcagcggttggattgaccttaaagccgagttctgcaagcacttcaagcacttcgtgctgggttgtcgcttgcacatcgtcaaaggtgacaatcgtgtacataaaggcactcaaattccgctcagccgctattttggcatctaattgccgtaaactaccagcagccgcattccgcgggtttgcaaatggcggttggccttctgcttcccgtttttcatttaatgccgcaaaagaggctttgggcatgtaacattcaccgcggacctcaatagagactggcttggttaatgtttgcggaatcgccttgatggtcttgagattttgggtaatgtcttccccaatcgtcccattgcctcgcgtcgcaccacggacaaattgccctttttcatagatcaagtcaatcgcgagtccatcaatttttaattcgacattatattcgatggcatgctcaacgtttttttgaagtcgattatcaaaagtcgcgagttcttcctcagaaaaaacatcgcccattgataacatcggtacttcatgcgtcactttcttaaagccaggcagaacttgatcaccgactttttgagtgggcgagtcattagtaacaatgattggaaaggccgcttctaacgtttctaagtcgcgatacaattcatcgtacacgtgatcttcaaccactggggcgtcctttgtgtaataggcttcgctgtattcagctaatgtctggcggagttcttgggccgccgctgccgcttcagtttgcgtatattgatcgattggtttagctaatcccataatgaagactcctcactgtttatgatttgaaacgtgctttttaaagctgactcttgtgcttagcttcgtattgcaaacgaccgactttgtcggtcattcacaacactgtgctaatgctcagagtcaaatccgctttaaacacactctgttttgaaacgtgctttttggttgcaacaacttccgcttaatctaaaatttcaaataatcctaaaaccaagattattcgcaattttttattaatgctcagttgctgaccgcaaccaaacgcactctgattcttaaacgtgctttttccgacatcttcttccggttagcgctactcgtcaaacaactgcttgcagcagttattcgccgagttgtgctaatcctcagaagataaccgtcggaaacgcactctattctactttttcaattggtgcgaagcttgctagtagtcttttaacgccttgttctttgaaggcgatatctagttcttggtcgttgcctgtcccgttgaccttgacaactgtgccaatgccccacttcttgtgttggactttttggccggctgtccaagcaccgctgttatcgccgccagttgtgtcggcaatcttgtgactcgtcgttgttttatttgcattatacgttgtagccgttgcgcgtgcataacgattgctcttaccaaatggcacattgcgttctggaatactgccagcattgccatttgcgtaatccaataatttatcatcgatttcgccgacaaatcgggacgcttggttactttgttgacggccgtataacatccgtgaataagcgttggttaagtacaatttgctttcagcacgggtaatcccaacatatgccaaacggcgttcttcttccagttcgtcttcttctaataaagcacgtgatagtgggaagatgccttcttccatccccatcaagaaaacgactgggaattcaagtcctttagcagcatgcaaggtcatcatggtcacttcactggcttcttcttcgactgaatctaaatcagagaccaatgataattcggctaagaagtccacaaataaatcactgtcatcttcttctggttcataatgttcgtcgaattgtttcgtaactgagagtaattcttcaatattttctaaacgactttgcgcttcgagggtgttttcaacttcgagcgcttttttgtagccagtcttatccaataattgttccgttaattccgtcacgtttaaaaattcgcgcatcttcgctaagtcaccaatgacgttgccaaaatcgatcaacgtcttgcgactcttacctggaatggttgagagttccgcattttgcgccgcttcaagtaatgaccattgatgatcatccgcgaattgcgttaatttttcgagagtgccggggccaattccccgtttcggactgttaacaacccgttcaaaactcattgaatcagacgcattcacgactaggcgtaaataagccaagatatccttgatttctttacgatcgtagaacttatgcccgccgaccatcttgtatggcatgttggctttgacaaacgcttcttcaattgaccgtgattgggcatttgtccggtataaaacggcaaagtcgccgaatttacgttggttcttttgcatttcttcttggatcttcgtaatgacaaagagtgcttcgtcacgttcactttgaccccgataataagtaattggttgtccttcgttattttcagtccacaattccttaggtttacgatattgattattgttaatcacaccgttcgctgcttctagaatcgttttggttgaacgataattttgttccaacatgactgatttagcatctggataatcatgttcgaagttcatgatgttgtccatgttagcgccccgccagccataaatactctgatcggcatccccaactacacagagattcttgtatttctcagctaacatgttaaccaatgtgtactgcgcttcattggtatcttggtattcatcaacgtggatgtattggaatttttcttgataatgttcaagcgttggcttgttttctttaaataagcggatcgtttgcatgattaaatcatcgaaatcgagcgcttgattttgttggagtcgtttttgatattcggtgtagcattgggccacaattttttcgaatggtccgtttgctagacccgcatagtcgcttggtgtttggagttcatttttggcgttactaatcgtgcctaaaatcgcctttggttcaaacttcttcgtgtcgatgtttaaatcccgacaaacatggcgcattaacgtcaattgttcagaaggatccgcgattgtaaacgcgcgattgtagccaatttgttcaatctcccgacgtaaaatccgcacacaaagggcatggaaggtagatacccaaacatcttgagccccttcgccgagtaagttaccgacccgttcacgcatttcacgcgccgctttattcgtaaacgtaatcgccagcacgcgccatggtaaaacgtgcttttcttcaattaaataagcgacccgatgcgttaacacccgggtcttcccactgccagcacccgccatgattaaaagtgggccttctgttgtgaggaccgcttcagcttgcttatcgttcatcccttgtaacaattctttttcagacaaattagtcatccttccgtaaatgcaatcagcctatattataccaaactagataggtagaaaaaagcgaacacgacctagtaaaacggattctaatttttcgcaatcttctgccttgacctgggacgcgtttcataaattatactcaccttaatccaagaaaggtggtatgcatcatgattaaatacattttttctaacttagacggtacattgttaaaccaagacggacagctttccgaaaaagatattacggctgtcaaagcaagcccactcccaatttccttgatttctgcgcgttcaccacaagaaatgcaagctacgattgatcagttagcgttaacgacaccccaagtcgcttttaacggggggttaatttatcaaccgacagatcttttcccaatggttttagcagaatatccacttgcaacctctgctgtcgcaacattaattgccgcattacaatctgaatttagtgacatcagtttaagtgcgtatgacttacaccactggtacacgcagacaattgacgctggtattgaggcaatcgctaagcaaaccggtcaattgccgacgctcatcaattttagtgatcaattgcaaaatccatttctcaagcttttcaaaattcaactgattatgcaaacgacacaacaacgggcaactgttgctgatttcatcaaccaatgccacttgcctggtctttcagtacaacaatcaggtacaatgaccttagaaattacgagtcatgaagccactaaagctaacgcattaaccaccatcttagaaaacactggactaacagtcgctgattgcgccgcgtttggtgaaggtcaaaacgacttagccatgttatcgctagttggccaccccatcgtcatgggcaatgccagtgatcaaatccagatggcgggtcaattcattacgaagactaatcatcacagtggcttcagctatggtctaaagaaatacattactaaagttaatcaaaaagtaggttaggattatgccaacaattcgtgatattgcccgcaaaagcggctattcggtttcgaccgtctcccgtgtgttaaatcatcaaaaatacgtctctgaacctaccaaaacggcaatcgaagcggtcattaaacaactcgattacgtgcctaatagcttagcgcgcgatttaagcttcggtcaaaataaaaatattggggtcgtcctaccgcacaatgaccatccgtatttcaaccaactcttaaacgggattatggatgctgcgttttcaagcggctatcacgttgtgctcctaccttccgaatataatcaagcagtcgaactagattatctcgaacaattaaaacgtaagaattttaccgcactcatttttacttcacatggtattgcactctcagtcttagcagagtacacgcgttatggtcaaattgtctgttgtgaagacccggggacccatcatatctcggccgtttattctcaccgtgagcccgcctatttagcggcattcaagtaccttaaagcccacaaagcacagcaaattggtctactattaagtcgtaatttagcgcaaagcccgacctggattgccgtcacgaacgcttatcaacaagttttcaactgccaacctgattccgagttaatggtcggtggcatgcgctcatttgaagatggctatcgcgccgctgaacaactggttgaaaaacagccaaccctcgcttgctattttacaaatggcgacgacattgccgctggtgtccgccaatatcatctggatcatcaactgccgaccccgcttttaattggtcaagaaaaacaattatccagttttttattgcaactgccaacaattgaccatcacttcttcaccctagggcaaaaagcgtttgaagtcgccctcagtaaccatcaccaagtttgtcgtttcgaatcagaatttattttgccataaaaaaagccaccttaacctaacttttaggctaaggtggctttttatgtcggatgcttatgcaaacacccgatcaaaaattgtttgaacttgttttaagtgccattggtaatcaaaggcgtcgtctaaatcggcttttgaaagttcactcgtcactttcggatcggcttctaataattggcggaaatctttttgttcatcccatgctaaggctgtcttcggttggaccaaatcataggctgcttcacggctcagacccgcatccactaacttcaacaagacacgttggctgtaaattaaaccatgggtgatgttcatgtcagccttcatcttttcagggaagaccgtcaacgtcttcacaatccgcgtgaagcgattcaagatgtagtccaataaaatcgtagtatcgggtaaaataatccgttcagctgagctatgtgagatatcgcgttcgtgccataatgacacatcttccatcccggtaatcacatgaccgcgaatcacacgggctaagccactaacgttttcagaactaattggattgcgtttatgcggcatcgctgatgaacctttttgacctttagcaaagaattcttccacttcgcggacttctgttcgttgtaaatgccggatttcagtcgcaaaatgttcgattgaggtcgccacgaccgccatcgtgttaatgtaatcagcatgtagatctcgtgggagcacttgcgttgaaatatcttgggcccggatccctaagtgttctgtcacataggcttcaatttcaggcggaatattggcgaaagtcccaactgcaccactgattttaccggcttcaacgccttttgctgcgcgttcaaaccggtcttgattgcgtttcatttcagcataccaggttgctagttttaacccaaacgtcgttggttcagcatgcacgccatgcgtccgcccaatcatcacggtattttggtattcgtaagctttatcttttagaacggccataaaattggcgatatcagcccggattaaatcgttcgcttgtttcaaaatatacccttgtgctgtatcaacaacgtccgttgaagttagaccatagtggacccactttttttcatccgctaaggattctgaaacggcacgggtgaatgcgaccacatcatggtgtgtgatggcttctaagcgattgacttctgccaaatcaaagctagcattcgcgcgaattttctgcgcatcctctgtgggaatatcgcctaattttgcccacgcttcgacagctagaatttcaacttccaaccaagcttgataccgattttccgttgtccaaatggcgcccatttcgggacgtgtataacgttctaacataaacttctcctccaaatactacctaaatgctggtgatggtaaaacgtgctttttgtggcatctttctgtgcttaaccaaatttgccaaattcgcgattgcatcaccaactcgtcaaatccagttaatgctcaaaagataaccgccacaaatgcactctgttttgaaacgtgctccatcgggcatctttctgcggctagctacgtccgtccaacgatcgactgcgtcgctcattcgccggcctatgctagtcctcaaaagataaccgcccgctgtcgcactctaatataagtctgccgcttcgtaattatcgattaagggttggatggcttgtccggttgctgtgaccgatccaatctgttgattggtcgtgacgttgtgcaaattaaagtaccaatccggtttgatcttcatctgtgtttgaattaatgaccgttgtgcttcttgaatccctaaggtcatccccgcattattgaggcgtgatgggccgactgccaactgacagatggccttcaaatgatattcatattgcgagaaattcaaggtatgtgtcaagacatcgcccgttgcgtgcggtgttggcataattcgtttcacataaatattcatagcgggtgttaaaaagaattcaaccccaaaaacacctgtatagtctaatttttccccaattaagtgggctaatcgattaatttcagtcgcaacatcttgattaatccgtgctggcacaagcgacattttcaagcgatgatcttcaaactcattttcgatgactggcagtgtcacacacttaccatcttcagttttaacgaccatcactgatagttcttgtgcgtcgggaatccaagattccaaaatataagtccccaactcaagagcagcttcaatgttttcaaggtcactcggttgttgaataaaacgttgatactgcttaccgtaacctttttgaatgggttttaagatacatggatatccgattgaatcgattgcatcttgaatatcatctacatcaacaactgtcgcatagggcggaatattgatatttaaatcactcaaaaagactttttcgaggtaccgatcttgcgtcacagacaacacattactgccttgaggtagataataatgttgtgccagttgttcgagcactgtctcatctaataattcattcgtataggtcaacacttgactgacttcaccgagttggactaatgtttgataatcattgaattcaccatcgatctgactatcaattaaacgtgcaaatgaggtattttgcatctgcggggtcacaatcgcggctacccgataccccatttcttttgctttgagcgccaacatataggcccgttgatcatttccaataattccgatggtttgtcctggataaataactggcatcatattacctgctttcctgttcaccaaactgtatacccttattatagcgaatttaagcgttgtctgcctaatactttcctccatgataacaaatttttagacaaaaaagagtacctctcagcactccgttaaataacatttatttattttcgtctaaaaagacgacttgaccgtcttcaaacgctgcaattcgtgctaaagattccacttgaatgccgcgttgatctaacaattcgcgacctttttggaaagtcttttcgatgacaatcccgacaccttcaagttgtgcgccggcttcttcaataatagaaagtaagccttcaaccgcttgcccgttggctaagaaatcatcaatcactaaaacgcgatcgtctgcattcagaaacttcttcgaaattgaaatgtggttattcactttcttcgtatatgaataaaccgttgcactgtacatgttatcttgtaacgtcaaactcttgtgctttcttgcaaaaacaacgggaacgtggaatgctaagcccgcgaaaacagcgggcgcaatgccagatgattcaaccgttaggattttagtaatcttcttatccttaaataagcgttggaattcttcacccattgcagccattaaatctggatccacttggtgatttaagaagttatcgaccttcaatacgtcttgacctaatacttgaccatcttttttaatgcgttcctctaatagtcgcacgctgagctctcctttgtagcatcgttaaacatcactaccgatagtagtaacgactaataatgttttctgaaattgaattaaaaatagattaccacaaaaaaagcaacacaacaagctcaaatccagttattcagcgattggaaaagagcctgtcacaaaccgaaatttgtggcaggctcttttgagattaattagtagcagatttcccatgatttgtttcatagcattctttattgatcatattggtcgaggtggtaagccttaacgagctcaattaacttcgctggataatcagggtcagtcgcatagccgtcttgttgtaaagcatgggcagcttgctcataattagtggccgcgattacgtgtgcatactgcgtccggttccaagaggtcccataagcaaacaattgtacatggtcaagcatcgattcttgataattgttatatactctaaaacgcgctgttgtcgttacccactgaccatttaaatattccttggtcgtcatttccttggtgttggcctcattatcacccttaataccgaaataattatggtattgcgcagcaagtgagctcttcccccaatcactttctaaaatagcttgcgctaaagtaatacttggtaaaacatgatatttcgtctgtaattcttgggcatatggcaccatttttttaataaacgcttgcttcttagcttggcgcgattgttgttcctgtctggcttgatcggcaagttcttcttgggccttttgtccattataccgaactaataaaacgagcccaattccgagaataaatagactcactaaaacgaccactagccaatcggttgggtggcgtctcttcttagagtagtagttagctgttggtttgcgttttgtcgtcttgcgtttacgtttttttgccaatcctctgcctcaactttatctgaatctattctatattgtacacaaattcattcagaacaccaatctttaatttgtaacccccctttaatttctatttagcgcttttattgctataatattggctgtaaccgattacgatagtaaaggactgattttattgacaacgcttaactggggaattatcggcttaggcaatatcgccaatagtttcgcaacttattttaaccaacctgatggtcacatttatggggctgcttctcgttcactcgataaggcacaagcctttgccgaccaatacaatattccacatgcattcggtagttatgccgacatgctcggtgatgacaacatcgacatcgtctacattgcaaccccccacaattatcacttcgaaagcattatggcgagtcttgaagccggtaaacacgtcttctgtgaaaaagcgattacgatgaaccgccgcgaactcaatgcagcaaaggctcttgctaacgaaaagcacttgatattagctgaagcaatgaccatttatcacatgccattgtttgctgagattgaacgccaacaagtcgctaatcacttgggcgctttaaaatcaattcaagtctcttttggaagttataaagagcttgatccaaacaatcgcttcttcagtcccgcacttgccggcggtgcaatgcttgatattggtgtttatgccctctcatttgcacgtcggatgttaactgctaaaccagaacttgtagcgacgcaatgggtgccatcagaatccggtgttgatcagcaatcaacattacttttaaataatgccaagcatgaaatggtgactgttaccttaaacattcatgcgaagatgcctaaacaaggtgttctcgtttatgaaaatggctatgtcaccgttgacgattatccacggcctgacaaagccaccctcactttcccagatggtcgcgttgagaccattcaagcgggtgacgcaaccaacgcaatgaactatgaactccatgatttccaagaaacagtgcgcggaaatcaatcaaacgataccctcgaattatcaagcgatgtcatggacatcatgtcagacgcacgtgctgaatggggctttgtctatccatttgaaaaacgcactgatctcgattaatccattcaaaaaacctggccaatttggtcaggtttttttagagtattttagcgagaaccaccatatcttttaggcgaatcccattttcatagattggcgtttgatattggtcgaagaagtttttgcgaattcgttcgaaccgaaagccttgacgcaaataaaaaccaatcgctgccaaactaccgtccccagtgccaactagcaatgattgaaacccttggtcaattgcaatcgtctgaatttgagtcatcatttgcccaccgaatcctcgatgttgccattctggccgtaccgcaatatttttaagttctacctgctgatcgttgagtgccatcagatggaaggccccgatgacttgctgctgatcgcttacggtgtaaaattgcccatgcatcaaatagcgttcaatcatgccgacttcttcatccgctaacaatagatcatccagccactgtcgccgtgctgcgccctcaatcaattgatacgttaacatctccagctcaccacccaatcaaaaaaggggtcgcgacaaaattgcttttgccgcgacccctaggttaatttttaaattagtttttgtttacgttaacagcttgtgggccgcggtcgctttcttcgatatcgaaagaaacgctttgaccttcttcaagagtcttgtagccttcaccttggatagctgagaaatgtacgaatacatcactaccatcttcgcgagttacaaagccgtaacctttttctgcgttaaaccattttacagttccgttttccatgagaaaaatcctccttgtgtcgatgacacattataaatttgtgtatttctggtggtccgatggaagaaagttcttttggaaacattcgtaccgcaaccattcaaaaagtacaaacatagtgtaacacaggcaacaaccattggcaaccatttggcaataaaaataaaccgttttctatcacggacaatcagcatccgtgtttttagacaagtgttattttatatgttgaatcatgccctaaataatttggctttttgctttaattacgttaagatagcagtataactttttctcattggagtgcttgcttatgctaaaactattgaaacggctattaccaattatcttcatcggggtgagcctagccgcttgccaaaaaccgatggatactaaacatcaactccaagccgatatgcaaaccgttgaagatgcgactaagcaacaacgaacagctctttcaaccctcgaaacaatcggcgatccagttcctgataactatctcacgattcaaaaaaaatatcccgacgaaaatctattaacgattgaagatactaagattgcgacgactgcggccaagcgcgaagcagcctttcaaagtcttaaagaacaacaagctgtgctcaaaccggtcattaaacgcctcaccaaactggtcaagcaagaaaacgatgaattgccgattgaacaagtcaaagatttaaatcaaagtcttaagatttcgacacttgattatacaaccttggccaccttctacaacgcggccactaaagtatctgatgaattttacagcgaccatacagatgctgatgcagacgaagacagtcttaaatcaccaatcaatcgtttaaatcaatattacagttcagtttatcaacaagccgaaattgctaaggtcaacatgaacacagttgctgcgcatgctaagaaagtgcaaaaacaactggaataaacaaaaaaggagttggacaaagtcacgtttgtccaactccttttttcaatctttaattattcaacccgtggcggaccacaatcgtcggctgtagctacccgcacttgttattgcgtccgtttaaaccgcatgagtggtgttgcgactagtggtgtcaccacagctgctaaggttgcttccattacagcatttaacgcaacaacgccaagcatcacgatgattaaatgggtcggatcagtatgatacatccctgccgcttggtgtccgtaaagcacacgcgttaagccaatcactaaaatggtattgattaaagccccgaaaatcccagctaaagccattgcaccggttttacgaattttagtttgatataagtgttggaacgtaaagccagcaatcatcccagccatcaaccgcggtaaaatagcgataattggattttgaaagattaaaagtgaaagcggatcgcctggagaggtataggctctaaataatgaaatcaaaccccaaattaatcctagaatcgccccttggcgtgtgcccaggatcacggccccaataatgaccgttaaatgaattgttgttacggctggtagcccaggaatgatattaatataaccgaccatcggaataaaactttgaatgattaaaaaagcggttaaaatcgccataatactaatcgtataagctgatgaatttttatgtgtcatcctaactgactcctaaactgaatttattgctcattatagcgatttgtcaccctagtttcaatcatttacatcaagggacaaaaaaaggtaattccaattggaattacctaactgaattatgatgcgggtgagaagactcgaacttccaccgggaaaattcccgacaagatccttaatcttgcgcgtctgccattccgccacacccgcgtaacttgctttatcactttaagccacgtacattagtataagagaaacgatgattgaagtcaattaaaattttactttggagacgattacatgcccattatccccgctaaactaaccgatattgccaaattaaccaccctgtatcaacaattaacgactgaaatgcatgtgctacaacccactaattaccaagctgattacacgcctgagttctttgactggcaacaaatgataactgatccactacaagcagtctttgttcatcaaaaccaagatgcgcaaatcgatgccttttgtcacgttacaacagcccaaacaagtccctcacccttgtttatcgcacaccgctttgcttatctcacaacactgtatgttgcaccagaggcacgccgccaccacgtcgctacacaactgctatcgtccgcaaagcaatggcaacaaacacaagcgctcgattatttagaactaaccgtgttagggaataatccggctgcgttggccctctatcagatgctgggctacaccactcagaatcaaactttacgcgccaactaaaaaaaggccacccctaaacataggggtggccttttttcattgaatttgtgtggtttgataaatcagtcgtccatgacaccgccgacaaacatagcgagccgtattcattcgacggcgacgtggatagacttgcccacagtctgaacatttataaatcacaattttgctcgatttagctgtcttttgtgcagctggtgcatagcgcgcacccccgacttgtgcaagtaattgtttaaactctgcgtctcgatgacggtaaccgcgatgcaacagatgcaggtgataatggcaaagctcatgcttaatcaccccttctaaggtctgtgtatcatgttcggtcaacatctttggattgatatcgatatgatgatcctgtaaatgatagcgcccgccggttgtttttaaacgccgattgaaatttgcttgatgcacaaacggccgattaaaaaactgcaacgataaccgttcaatcaattcagttaaggcttgatcagtcatttgcctttggcgctttcattgtcagttgtacgcgttcacgttcttgatcaacactcatcacccaaacctgaacgacgtcgccaactgccacttcatcagaaggatgtttaacaaagtggtttgccagttgagaaatgtgcactaagccatcgtgtttcacaccaatatcgacaaaggccccaaaatcaatcacgttgcggactgtgccttctaacgccatattcggtttcaaatccgccaaggttaagacatcatgacgtaacaatggcgccgtcatctgatcccgtaaatcacgccctggtttttgcaaactacctaagatgtcggtgattgtttcaaccccgacctctaattcagccgctagagccggtacttgcacttgtgcaatcgccgtcttcaacgcatcgcttcctaaagcagcaacggttaacccaaatgatttcaaaatggctttagccgttggataactttctggatgaatatcagtattatcgagtggattgtccccattaataatccgcaagaatccgaccgattgttcataagctttaggccctaagcgtggtactttcttcaaagcactccgcttttgataaaggccgttttcattgcgatattgcacaatgttttgagcagtagttgctgacaaccctgagatatgttgtagcagctgagggctagccgtattcaggttgactcccacactattcacgacatcctcaatcactgtatcgagttgcacagtgagctctttttgcgccacatcgtgttgatattgtccaacacccactgcttgtggatcaatcttgatcaattcagctaacggatcttgcaaacgacgggcaatactaatcgcacttcgttcttcaacgtgtaaatctggaaattctgcccgtgctgcatcactcgcagaataaacagaagcccccgcttcattgacaatcacatagaaaatttcccgggaaatagatttcaaacacgtcgttacgaattcttctgattcacgactcgcagtcccattaccgattgcaatcatttcaacttgatatttctcgagtaaagcagtgaattcatccgccgcttttgatcgtttgtcagctgaagctggtttgtgtgggtaaatgactaacttatccaagaattttccagtgccatcgacaacggctaatttacacccagtccgataagcgggatcaaagcctaatacaactttacccttcaatggtggttgcaacaagagatgcttcaagttatcaccaaagacactaatcgcttgttgatcagctttctcctttaattgcttgcgtaattcacgctcaattgccggtccaataaaccgcttataggcatcttcaaccgcagacttgatgaccattgctgacgctgaatcttgtccatacaacagatcttggctgatccgactggcaattacttgatcgtcaatcataattttagctttcaaaataccttcgttttcaccacgattaatcgctaaatattgatgttccgctaccttcgttaaatcggcagtgaaatcataatagatttgataaacttgcttctcatcggctgcttcgtctttaacttgactggccaactgaccattttgccaagtatattggcgcacccaattccgatattttgctgtttcactaatattttccgccaatatttcatgaacaccagctaaaacagcagctgtatcattgattttttgatctggattgaggtaagcttcagcttttgccaataatgcttgttcggttaagctaggtaaccctgcgataaactgcgcaaaaggttccaagccggcttctttagcgatggttgctttggtccgtcgtttttgtttatagggtaagtacagatcctctaaagcttgcagttgcgttgccgtttcaatttgttgtttgagttttggcgttaatttttcttgttcagcgatatttttcaaaatatcggttttacgtttttcgagcgtcgttaagtattgaaatgtgctttcaatttcacgaatttgaacttcatcgaggcttcccgttcgttcttttcgataccgcgcaacaaacggtacggtattgccttcttctaaaagacctaacgttgttttgatttgttgtggtcgatactgtgttaattgttgaatcacaagattttgaatatcaggcatctgattgcactccttttgcttcaattaaaaaaacagcccccgacttgggaactgtcaactttcgccctaagcgattcttgaaatattttggatgtatttagaaatccgttccgttgctttgtcttgattcatttctgaagctgcaaaagcttgcatatcaacggtttgatcatcatgcatgcttgtaattaaatcttcacagccttgaatgaaatcagcgtaagcaccgattaaacgttggttgttccccatcaaacgagcgggcgcaacaactgttttgaattgtgctaagaattcgtgatattgatcaacaccatctctgaagatttgtgctgtcttttgatagtcttgttcgctcatttcggctaacttaccatcagcaacggctgcttttaaaggggtgaaatacttactcatcccttcttgtactttttcagtattatcgattaaatcgttgacagcttggccgtatttggcaagcttttgttgcgttttattcatgtccatcctcctagtttcctatggtttagtatactaatttcccaatcggcttgcaattaaaatattaaagcatgtgtcattaatagaaaaggcatgcttagttcatcaaaggacatttacctcattaaaaaaacgctagcgacaaaatctcgtttgtcactagcgtcgattattacctatcttctcttcaacattctactcgtccacgactgaccaaacattaactttgtcaataagtcgatacaaaagtaagaaactcaacaaccaattattttgaacgtgagtaatccgttccagaccaccaaagatgaaaagtgatatcagaaactgtaagaatatttgcatacgtaatcctccctacaaaactcactaacataaaagttatttaatcacctttattatagtttaattgacaagcactttacaaggttggcaacaaattatttagccattctccgctggaagaacttcacaatttccacaatcacaatcaatgagaatgaggctgctaggacaattccccattggtgaatatcgagatgtgacacgtggaataggccgtttaagccaggtaccataatcgttgcggctaacaggaggaatgaagctaagacagcccagttgaaagctttattcttgaaaaagccaactgtaaagattgattggtgcactgacttcacgttaaacgcgtggaagagttgaatcatccctaacgttgcataggccatcgttaacgcatcagcatgtgctaagccgctcgcttgatgcactgggtacgtaatcgctaaggcatacacaccaagcgtaatcccaccttctaagagaccttgatagataatcgcttggaagacaccgccggagaagaagtttgacttgcgcccacgtggtttttgattcataatccccggttcagtgggctcaacccccaacgcaatcgctgggaatgtatccgtcactaagttaatccataagatgtgcaccggttgcagaatttgccagcctaaaatcgtcatcatgaataaggtaaggacttcacctaggttagctgacaataaatattgaattgatttttgaatgttggcaaagactttacgaccttctttaacagccacgacaatcgttgagaagttatcatcggcaagcaccatatcactggcgccttttgatacttctgtcccggtaatccccatcccaatcccgatatctgcggacttcaaggctggcgcatcattgacaccatccccggtcatcgcaacgactttaccatgtttttgccaagctctaacaatccgcaccttatgttctggcgcaactcgcgcataaactgcgtactgactgacttttttagcaaatgtctcgtcatccatttgatccagttcggcacctgtcacaacggccgcatccgcatcttgttcaggtgtaataatccctaaacgaagtgcgatggcttctgcagtatcccggtgatcaccggtaatcattaacgtccgaatccctgctgaatgcgcatcagttacagcttgtttggcttctggtcgttctggatcaatcatcccgactaaaccagcaaagatcaactcatcttcaatcgtcggatcaattgttgctggtaagctatctaacggtttatacgctaatgccaagacacgtaacgcttgtttcgctaaatcgtggtttgttttgagtaaaaattgccgttcatcttcatctaacggttgaacatcgccattggcatcaataaaatgactcacgcgtttgagtaattcatccggtgcacccttagtggtcattaataattgaccatctttggcttgatgaatcgttgtcatcagcttccgttctgaatcaaacggtacttcacccacgcgtggtgctgctgctagggcatcttggatcacgaaacctttatcacgcccataagcaattaaagccgtttccgttggatcaccaattaactggccatcctctgtgattttcgtatcgttggcaaggttcataatgcttaacgctaaatcatcgcctgccaagtcggctgatgcttcttgcaactgattattggtaaaaatcttttctaccgtcatttgattcatcgttaacgtcccagttttatcggacgcaataatgtcggtactccccagtgtttccacagcaggtaacttccgtaccaacgcatttcgtttaaccatcttctgtgtcccaagggctaaaataaccgtcacaattgccggtaatccttctggaattgcggcaaccgctaatgagattgaggttaataacatgttaattggtgattgcgcgtggcgtaagtagccgaccacaaatacaacagccgcaatgattaaaatcataatcgttaaactcttaccaagttgacttaaattcatttgcaatggtgttgtggtttcaccagcttgatttaacatcccagcaattttaccaacttcagtttgcatcccagtgcccgtcacaaccccgacaccacgaccgtaagtcacattactattcatgaatgccatgttggtccgatcgccaatcccactttcaggatcggttaacgttgcaacagtcttatcaaccggtaccgattcacccgtcaaagccgattcctcaatcttcaaagccgctgattctaacaagcgtaaatcagctgggacgatatcgcccgcttctaatagcacgatatcaccgacaaccagttcttcactcttgattttaacaatctgcccgttacggcgtacatgtgcgtccggggttgccatctcttttaaagcatcaattgcttgttccgctttggcttcttggaaaacaccaaaaacggcattcaagataacaacggcgagaataataatcgcatctggccattcatgtgctaaaaagccggcaatcattgccgctactaataagacgataatcatgaaatctttgaactgttctaaaaaacgaatcgctaaacttttgcgtttcttttcagttaattgatttcgaccattttctgccaaacgtttttcaacctgttcttgggttaacccttgtggcgttgtggcgagcgctttaagtgttgcatctattgattgtgtaaaaaatgtggtttgtttatcgaccattaccttgcctcctataaatttgattttgggggtaaaaaaagagacctacaggaattctaaaaatccctataagtctcactaattaagataacaccagaatattgccttgttggtggcgttatcgcagacaagctgccagttactcccttatcgttaacctcattataaggtatagacaatctaaaaggcaagtaaatagttattttaataactaaattagtttacgaaactaggctcgaaagctaaccactgacaacgcactctgttttttaaacgtgctttttgaaactgacttctgcgcttagcgtcactcgtcaaacaactgcttacagcagttattcgccgagctgtgctaatgctcaaagtcaaaccgtttcaaacgcactctgttttattgccagaacgtgtcgtagattgttattggtaaatgacgcttgtgggccgttttcttgtaccagttttcaatcttcgttgcggcttcttcactgacttgacgaccttctaaatagtcgtcgatttgatcatatgtgacacccaatgctaattcatctggtaatgccggacggtcttcttcaagatccgccgttggtactttttcataaagatgtttaggcgcaccgagttcagctaacatggccttaccctgacgcttattgagtctgaagattggcaccaaatcagcaccgccatcaccaaacttcgtataaaaaccagtaattgattcggcggagtgatccgttcccaaaacagcgccgctattttcaccagcgatgccatattgcgcaatcatccgcacgcgggccttaatattgcccttattgaagtcactgacggttacaccggtttctgcaagggattgaaccatcgcgtccactgagcccttaatattgatccgtttgacttgatcagctgccataaattcgattgcggccatcgcatccgattcatcagcttgttccccataaggtaaccgcactgcgataaattgataattttcatcgccagtttcagcccgcatttcttgcatggctttttcagcaagtgcgcccactaaagttgaatcttggccgcctgaaatgcctaagacataggtttttaaaaatgtatttttctttagataagccttcataaaatcaaccgagcggcggatctctttggcggggtcaatcgttggttgtgtttttaaggctgcaataatttctgcttgtaaagcgttcatttgccagatactccttcaaaaataatcgattctagtgcattaaattaacgtctcctctgactttgcgaattgaattcatcttattatcccaagtccgttgtgataaatcgactggataatcttgtggattcaagtcccgtttgtattcatcccagagtgaatcaaggttttcagcacagaacttcttaatcgccgctaattcaggcaacgtatagacccgtttaccattttcaaaaatagtccgtaaaattggtcgggcattgaagtcggtcacggtcttattgatgtacgtgtaattagggtggaacatgtaaatcgtatcttgttcaagtggatcttcatcccataacgtgatgtagtccccttctgatttaccgtcaacttgtttggtaattcgccaaacttgcttgcggcctggtgttgagactttttcagcattacttgataatttaatcgtatcgaccatcttgccatctgaattttcaattgaaacgagcttataaaccgcgcccaaggctggttggtcataagcagtaattaacttcgtcccaacgccccaaacatcgattttagcttcttgcatcttcaagttttggattgtcttttcatctaaatcgttagaagcgtaaattttagcgtccgtgaagcctgcttcatccaattgttggcgcacacgcttagaaatataagccatatcaccactatcaatccgcacgccttggaaattaatccgactgccgaattcgcgcgcaactcgaatcgcacttggcacaccacttttcaaagtatcataagtatccacaaggaagacacagtcccgatgcgtttcagcgtaggcccggaaggcttcgtaatcgttacgataggcttggactaatgaatgcgcatgcgtcccacttgctggaatcccgaaaattttagaagctcgcacattactggttgcatcaaagccaccgatataagcagcgcgtgtgccccataaagcagcgtccatttcttgggcccggcgcgttccgaattctaagacgggatccttgccgaccactgatttgatccgtgctgctttagtcgcaatcaatgtttgatagttgacaatgtttaatagcgatgtttcaatcaattgacattgggcgagcggcccttccacttgcataatcggttcgttgccaaagaccaattcgccttcaactgctgagcgaatcgttaaatcaaaatctaattctgctagatacgtcaaaaaatcttcaggataaccgacttcatcccgtaaataagctaaatcgctctcggtaaagcggagattctcaagataattaacgatatgttctaagccagcaaaaatcgcatacccattttcaaaaggtaattttctgaaatagcattcgaaaaccgctgtccgattatggagtccctttttaaaataagttaacatcatattgagctgatacaagtctgtatgtaacaacaaactatcatcaggatataatttttgcatgtcgcactcctaattagagatatatttggtataactatatcataaaataaaacaagcaatcaaaaaatagtaccgtcatttaaactttgtgggctaataaaaaggatgccgctaaacatcggcatccttttcagaaaaaatcataattaatccttatccatcaaagtagtggctgttgccaaggtaataatcgatagacaagtaattaaggtacccaatgttggttgatttagactaaccactaatgttgggaagtacgtcaataacatcattaataatgccgtcttagttaagttgatacgttcaataaacagtaacaaaattggtcctagtaaaatcaaataacaaataatcgttccaattaaaccaaatggtaataggtatagtagtactaaattatgcggcttctgataaccccaattttttgtgtagacggaagacatgccaattccaactaagaaattacgtggatttgcattaatttgttttttcgacttatcgttaataataatccgcatatagttacttaacttaatactcttttcaacatcttctgctcgttttttcttattctcttttttcttttctgctttgcttaaattcttaggtgcgaataaaccatgcacatcaaatttcatagcattcggcacaaccttattgtatacattaacagggacgtcaacagaacgtactaaattttgtttattaacaggacttgccaatattccaaccaacccaaacgaaactacgataatacctacaaatattcctaaaagttgccagaacttcttcaactcaatttttttaagtaagataactgcaatcaaagaaattacaatctcaaacattccaacagaaaaagcaattcttgatccagctaatagtaaagtcggaatgctgagtgctaataagctccatgttgttactgtgtagaagatatccttttttcgtgaaatacaataaaccaatactggataaaacattagtaggcagatataactcgtaatactattacctagtaaattatgatttccaagtctaatttcacctaccccaaaaaagataataccatattggaataaaaccgaaactaggtttcctaataacaatgccgtaaatatttcttgaaatttgattttaaaatacgcgagcgaaatcgcaacaatacaaacttcaataataattcgtgctaatagaaagctactaaccaaagtcatatgcgtcatataccgataaataaatgttgcgatatagaatatgccaaaggtaaaaagaagggtaaagtaatatttgacccaaattgaagatttcgataattctctcttaataattaatcgccaaaacacagtatataatccgatggcaaaaataacgaactcaattataaaaatctttgccgttccgttagctgcaccactagtcgagataccaatcgttgcctgtgaaaaaataaacactaatgccattagtgttgtagcaaatattttctttttagaactaactagatttgttaaaagcataagactctccttcttattaagttgctgaaaatgttaaaaaccggtataatactagcatattatagcagaaaaaggagttaaaatgaaattagtattttccagcttcccagaagtttcagataatacactaatcgtattgacagagatcattaaccaagaattaccggttaaatgttattggcttgttaatgatatgactaacttagatgacatcaaagaaaaactagcttattatctaggatctcgcagcgatcaagtaacgttagttcctaaaaaatcactttctggcctttttcattatctaactgctaactattcttttgggacacatggcatgtttgagcaattcccgttactgccttggcaaaagaaagtcaatctatggcatggtatgccattaaaaaaaattggccgtctctccggtaaccctgttaaatttaaaataagttatacagtttcaacagcaccagtttttgacgctgttattgccgaatcctttgaaatcaatgataatcaaattgtcaaagttggcttaccacgtaatgacttattctttaaaaatcgtattaacccacaaatcacccaattatttaacaatgattatccacttatcgcttggttaccgacttatcgacaaagtgcagtcggtgatattcgagtagatagtgttcaaatggatcaaaatattggtgggcttaatatccctgatttaatagaactaaatcaggcattactaacaaacaaaaaaaatctaattatcaagttacatccaatggatacattaaatgaacaactgaccacgttacctaaatttaagaatattaaacttctcaatagtgatggcttcaacgctcttcatattgaagttaatgattttttacgacacacaatcggtttagtgacagattattcttccgtctattttgactatctgttaatggaaaaaccaattggtatttttcaatttgatgaatctagttattcagaaaaaagaggctttacctctgatgaagttgctgataattttacaggttttaaaatcagtaacttatcagatttcgaatcatttattaaaaacattgaatctgaagcgttacatgaagatcttatcaaaaaaaataagttatttaatcgatatgacactgctggtaataatagtgcaacgctcttgaaaaaaattggcttattaaaataaagtgagggtttaaaatgactaaaattttaacatacggtacatttgatttactacatcgaggtcacattaatttattaaaacgtgcaaaagcgcttggtgatgaattaattgttggtgtttcaactgatgagttcaatgcccttaaaaataaaaaagcttactattcttttgaggatcgtaaatatattttagaagcaattaaatatgttgatcaagtaattccagaagaagactgggaacaaaaaaaattggatgttcagaaatacgatattgatatctttgtaatgggtgatgattggaaaggtaaattcgattttttaagtgattactgtaaagtgatttacctagatcgaacctccggcatttcaacaactaagataaaacatgatttaggagttaaataatgactaatgagttaaaagtagccgctattgtcgttacctttaataaggtagctttcttgtcaaagaatatcgaacacttactgaaccaagatacaactattgaagaaattattattgttgataatgcaagtacagatgatactgaaacatatatgacttccttagcagctaataacccaaaaattaactatcaaagacttacaaaaaatattggtggtgctggtggctttagtcatggtattaaaaccgcctttgataacccagttattgactacgcttgggttatggatgatgatacaatgcctcgtaacaattcattaacaacattattagatgctgcacacaatagactagccgataattttggattcttagttagcaatacacgttggacggatggtcacgccgctttaatgaacgtcccagaaacaacttccgattggaacgatcgtgttgccgataaccttgttggtattaaaaccggcaccttcgtttcttttatgacttctagaaaagttgtttcagaattaggactcccaatcaaagaattctttatttggagtgatgacttagaattttcatctagaatttcaaaaagatatcccagctatttagtgactgacagcttagttgatcatgaaatggcaaaaaatcagggtgttaaattcttagaagaaactgatgttaaccgtttaggtcgctatacgtacagttttagaaataaaatgtatattgaacggcgtgatggtcacaaaggttatcttagatataaaataagtttgttacttcttatgctaaccttaccattcaaatctgttgactttaaatggcagaaggagcgaatccttctaaagggatttaaccaaggtcttttctttaagcccactgttgaatttttaaataaaagataacattaaaaaggctaggattaataatcctagcctttttcgtactctaaatatttatcgcttaaagtttcgtccaatatttgaggttcacttcagccaaatgatttggcgggtctttttatcgtctaacgacgttcaaattgatacttaggttcttcaagctctggatcgtaatcaacctgtaaatcataatcggcaaaaaaccattcgtccgattgactcgcaaaataggtgataccatctttaacaaccgaaccaattggctgctcaacagtagcgcgttccatgcccaatgaaaagccatcatgcacggccgtttgaccatacactttgccaaaaaagcggactgcatcccccgattgtaaggctaattcgtcgcgaaaccattgacttgctgcatctgacacctgaatttgcatgttgaactcctcctgattaatcgactagttggttcttaatcgcataaattgccgcttgggtgcgatcatccacttgtaacttcgccaaaatatttgaaacgtgcgtcttgaccgtttttaacgtaatgaataattcatccgcaatctcttgattactacgacctttggcaatcaagcctaagacttcacgttcgcgattagttaagtcttcatataacttaggttcaaccggatgtgttaagcgattcatcatcttattcgtcacttctggctctaaaaccgattgtccttgcgccgttttacgaatcgtattggcaatttcctcggctgtagaagtttttaatatgtaactggccgcaccggcttcaatcgccggataaactttctcatcatcgataaaactcgttaagataatgattttggcttcaggccacgcctttaaaatcgttttggtggcctcaatgccatccatctcaggcatcactaagtccattaaaatcgcatcaggacgtaatgcaagcgccttttcgacaccttctttaccattgacggcttgatcgacgacatgaatatcgtcttgaacccctaaatacgttgagatgcctaatcgcaccatttcatggtcgtctactatcaatacattaatcacttaattggtctcctttaatagtggcactcgaatttcaacactcgttccctggttaggcaaactaataatttttgccgtccccccaacactatgggcccgttcgacaatgttgtttaacccataactgccggctttttgctcagcattcgtatcaaacccagtcccgtcatcaattacctttagtaaaacactctgaccgagttgtttcaagtatacttcaatctcttgggccttcgcatgccggagtgtgtttgacagcaactcttggataattctaaataaattatcttcgatgccacttggtaacgttatgctatcaatgtcccatgtaatctgaatcgcaattttggtcttcaattcgttcaataactgaatgatcccatcgcgtaaactcttgccttccaaattaactggtcgtagatgcaagagtaacgcccgcatttctgattgagcctcatttaacacccgttcaactgtcgttaaggactgcaacatctgcgcgttatcagcttgtttttgcgcaacttcactgagtgccgacagcatcatcgtcgccgcaaatagttgctgactcactgaatcatgtaactcgcgtgctaaacgatgccgttcttgcgctagaatttcttccttggtttcaccagcaatcacggtcggccgatcactataactttgaatctcttgttgtaagcgtatcattttttggcgtaattgttcaactgtttgctcgattgacatcgcgtagtcattggtttcgctctgtctaatctgaaaaacaggcgattcatactgtccagaaagtaaaaattgtaactggctttcagtatgggataattgcttacgtacgacaagatagacgattgcggtaactaaaaagcctactgccattgcggccaccacaatataaacaatcagtggtacatagaataattgcttcgtggccaaactaatcagccattgttcctgatgcgtactgtagaaatacgcaaaaaataacgccactgaaaacagaagcgtcaacaaactcgtgctgatccatataaagctccgcgttaacttgctcatactaagatcacctcaagatcaccaatcattacgttggtaatgattttaaggtggcgactttcttcatcatagtttgtactatacaactgaatcgactcatttttcaaattatagtgctgattgtcgattgtcacactccctaacattgcagagtgatcaagatagacaccggtcccgacaggcactaaaatccgtgtctttccaaaccccttacggatgacaatatggttgtcattcttgggtaaaatggtgctccctaaatcgataattgtatcaccggcagcgaccgcgaagttaatatcatcccattcaaaaatgttattgccaattgtctgatgaccaaaccaactatgccgcttgactgttgtctttttcgcggtgggttccgtcgtattaacgggaataaattttttcttgcgccaaggggcattatcaaacaactgattcatattgcggctgctaaactgtcccattcggctatgatttaaggctaaaaagacgaccgcaacaataatcattaaccataacgagaaattaattaacagtggtaccgtaacggctacgcaaccgaccatcgttaacaaagtcatccagacaccgattttacctttactacgacgtttgttggcccagactaagagtaaaatacctgcaatgatgaacactaaatttgcgggtatcgtaatcatctgccaaatgaacgtcccgaagataatcgcttctattattaaaaaaacgcgccagataaacggcatatttacggtcccctttcaactgattaatattattatacaagcaaaccagataaacgccaatccgtctcaaggctgattaacgaattaacggcaaaataaaaaagccacgggattgatttccgtggcttttttgaaacgtgctttttggctgcaacaacttctgcttaatctaaaattggcagtcatcctaaaatctggatgactgccaattttgtattaatgctcagttgctaaccgcacccaaaagcactctattcttaaacgtgctttttcgaacaaccttttccgattaactacaaaacgggcgtcatggtcaaaattcgatcataacacccgtttttaagttaatcctcaaagactaacccgttcgaaacgcactttatttaacttctgtaattgtgacgtgcatgtcgccgcctggtgtttgcacagctactttatcaccaacgtgtttgccaagtaatgcttgggcaattggtgaatcatttgaaattttaccactgaatgggtctgattctgcagcaccaacgatttggtaagtttcttcttcaccatcttcgtcgtctgtgaagctaactgttttaccaacagcaatttcatcagctgcgatgctatcaacatcgattacttctgcaaagcgtaacatattctcaacttctgcgatgcgtgtttccaatgagctttgttcatctttagctgattcatattcagagttttctgataaatcaccaaagctccgtgcaattttaatccggtcaatgacttctggtcgttttaccattttgagtgtttctagttcttcggctaacttttctttgccttctgcagtcattggataagttttttgtaccattttatccacctctttattttaattaataatactgactatcttaattactgtgtacgtccttgtcaaatctcaatctttaatcggcatttaggattgattgaatctttgttacaagtaaatcaatggccacgcgattattgccaccttctgggacaattaaatcagcgtaacgcttggttggttcaatgaattcatggaacatgggttttaccgtcttaagatattggccaaccacatcatcaaacgttcgaccacggctttccatatcgcgatgcatccgtcttaataaccgaatatcatcatcagtatccacataaaccttaatatccatcaaatcccgtaaccgggcatcagccaatacaagaatcccctccaagataataacatcttgcggttcaacccgttgaatttcctccgtccgattatgaattttataatcatagaccggttgttcaatggcttgatgattttttaacattgatgcttgttcgatcaataaatcggtgtcaaaagcatctggatgatcataattcgtttgttggcgttgttcaaacggaacatcttgccgtttgtaatacgcatcttgtggtaataacatcactgagtgattcgcaaatttttgggcgatagcctggctaacggttgttttcccgctaccggacccgcctgtaacgccgataatgatgggtgcttttttttgactggacatgggacgctccttttattctcaacttctttttgggcaaacagaagtcgacccccaatggcagtcgacttcgataatcctaaatgaacctaatcttcaatcgaatctgttgtatcgttatgttgttcgaaggttcttgagtaatatactttacccgtcttcaagttagcaacaaagtagagataattttgatcacgatcagctggattcaagacggctgtgacagactgtaaactaggtgagttaaacggtcctgggccataacctttattgatatataagttatacggtgaatcgactttagtatctttgttataaaggtgtgtcttgtgggtatttaaggcatacattactgaaatatcagattgaattggcatatcgatgtctaaacggttaaagaagacaccggcaatcttttggcgatcgacggccgtgaccccttcacgttcaaccaatgaagctagcgtcaacgtttgttgaacggttaacttcttatccttaatggttgcataataaggttgcatcttttgatccatcgttgaaaccatttcggtgataatttcttttaatgtactatctttataaacttcgtaagtggctgggaaaaggtacccttctaagtgatagcggacatccttttgagccattgttgatgacaataatgcagggtatttcttctctaaacttgctaagaattgcttatcattcgcttgtttgatgaaggctgctttagagaattttgtttgtttaccaacttcggccgcaatttcttctaaggtgaccccttctttaactaacaatttgcccttcacatcgcgaggacgggttggtgtgccttctttttgtaagttagagatgatcttatctaaccccattgattgtttcaacacatgataaccggcttggaaatccgagaaattatgagtcttcacataataattaaagactggcgcgcttcgaattaattttttatcctgcaaaatagcagcgatttgtttattcgttgagccgttgggaatgcgcacggtaatttcttgttttgctttggtatcgtatggtttaagagatacttgtacgtagcgatatcccatgaatccaataatgacaacaagtgctaatagaataccgataatccaatagacaattttatttgctgcttttttttctgcacggcgttcttcgtacaatgattgtgccgctttttcttgatttactggctccttttgatcaactttcttcaaaggatgacctcctaattgctcttttaaatacaatccttaaaacattataccaaattattcaaaaattgcattaaagattcgagattaacggattttggcatcaaaagtagcaactaattcagcgactactttttcaaaagcagcgttaacttcttcttctgttaaagtagctgcctcattgaggtacgttaaggtgtaagccattgacttctcaccagcctcaatatgactccctgcgtaaacatcgaaaagttcaactgaaactaagtgggcgccaccctttgctttgatagcttcaacaattgcggcatttgaaacttgatcagacacctgaattgcaatatcccgcgttacttcaggaaatttaggtgctggtttagcaatcactgtttgggttggcaaggctaggatttgtgctaaatctaattggaaaacataagtttcttttaaatgattagctttcgcaactgctggatgaatttgaccaacaaatccaaccagttgttcaccaacgtaaatggctgccgttcggccaggatgcatttctggataagcttgtgttggttgataactgattgcatccgctaagttgtaacttgccatcaacatttcaaccacacctttgattgtgtagaaatcaactggtgctgcggcagcttgccaagtcttcatttggcgattgccactcattaagccagccacatattcaatttctgttggccgaacttggtcatctgcttgttttaaaaatacccgtccttgttcgtatagtgcaagatcagtttgtttacgtgccacattgtaagcagcatcgtccaataaaccagtaatcaagttcatgcgtaagtgcgcatgatcttgcgtcattggccaatcaagtgctgtcagcgccgaatcaacaagcgtaaattgacgcgctttttcaggggtcgttaatgcataactaattgcttgcgttaaaccagcaccttcaagtgtatgccgggttttacggagtgccttttgttcagtcgttaatgccccggttgtcatatcgccagttggcaatgtgcttggtaagttatcgtaaccgtataaacgagcgacttcttcaatgatatccgcttggatttcaatatcccaacgccgtggtggaatcgttactgttaaatgattatcagtattgaccacaccaaaaccaaatcgttctaataattcaacaattgtttgcgttgcaatctctgtgcctaagacgcggttaatccggtcagcttcgatttcaatcactttgtcagttggcactaagtcagttgggctaactgtaccagcagtcacttgcccattaccaaggtctgccatcatcatagcagcagcatctaaggctgtttgaacatcagcaacattcacgcctttttcaaaccgtgatgatgcatctgaacgcaagttatggcgttgagccgttttacgaactgcaattggtgcaaaaactgcggcttcgataatcacatttttcgtatcagcagtaatttgtgagttcaaaccacccatgacccctgctagcgcaattggtcgatgaccatctgtaatgacgatatcttcatttgttaagtcatgttcgccttcatcaagggccgttaatttttcgcccgtcttggctaagcgaacttcgatttgtttgtgatcacccgttaaagcatccgcatcaaacgcgtgtaaaggttgaccatacgttaacatcatgtagttcgtcacatcaacaaggttattaatggggcgaatgccagcattccataaacgcgtctgtagccacattggacttggttggacggtcacgttttgcaacatacgcaagtgataacttggtgccaattgttcatcagcaacttgagcagtcaattgatcagctgtttggacgttgctttcagtcaccacgatatcttcaaaatgaggtgtcaatgattcaatggcggccacttcatgggccacaccgtggatgccaagcgcatcggctctgttagcggtgaggtcaagatcgataatataatcagtcatcccaagtgcttcataaacttctgtcccaggttcaattgcttctgggaagacaaagatgccatcaacatattccttaggcacaacgctatcggcaaagccaatttcttgtaagccacaaatcatccccattgaaaccacgccgcgcatcttgccttttttaatcttaacgttgtcagcaatccgagaattaggtaatgcaacgactacatattggccagcagcgacatttggtgcgccacaaacaatttggaagggttcatcttcaccaacatccacttggcaaacattcaagtgatcagaacccggatggggttcacaacttaaaatatgtcccaccacaatttttttcaagcccgcgctcttttgcgcgacatcagccacttcaatccctgttcgagtaattttttcagccaatgcctctggggcagttgttaaatctaaataatcttttaaccagttgtaagaaactttcatggtctagccctcctgtgtgaattgatttaagaatcgaacgtcatttaagtagaagttccggatatcatccacaccatatttcaacattgcaaagcgatcaatcccgagcccaaaggcgaatccaccatagacatctgagtcgacaccgccggcttttaagacgttcggatgtgtcatcccagcccctaagacttcgatccaacccgtttgcttgcagacattacagcctttaccatcacaacggaaacaagaaatatccacttcaacagatggttccgtaaatgggaagtaacttggccggaaacgtaaatcacggtcttcaccaaaaatatggtgaatcgtgtattctaaggtcccctttaagtctgccattgtaatgtttttatcaatcacttggccttccatttgatagaattgatgcgaatgcgttgcatcatccgtatcccgacggtaaacacggccgggactaatcatcttaatgggaccattagcaaagtcatggttttccaagtcacgtgcttcattgggtgacatgtgcgtgcgcatcaataaatcattagtaatatagaacgtatcttgcatatcacgggctggatgattagctggcatgtttaacatttcaaagttatgtttttcatcttccacttcatagccagcaacgacttgataacccattccgataaataaatcttctaaatcatcaatcacttgagttaagacatgcggggtcccttttttgaccggttggccaggtaatgtaacatctaatgtttcgtgagccagttgggctgctgccttcttggcttctaattctgccttccgggtttcgattgcttctgccaaatcactcttgatttcattagcaaatgcccccaccttaggtcgttcttcattacttaaatcacgcatgccgcgtaaaacttctgtaatcggtccttttttaccgagcacttccactcgaatttgatttaacgcctctaaatcaacaactctttgaatttcttgcagactcttttgctgtaagttttctaattgctcctttaatgacattgcaattcctccttatttttttcaacaaaaaaagcccgtccctcaaaaagggacgaagcttcgcggtaccaccctagtttacgaccattccagtcatacactcaagtttgcgctaacgggcaataccggaccaatggtcaactcagaaagtgaacttcacctaaacttagttgaataacttgcagtcaactgattattctccctgaaaactaatgattaggttactctttttcgtctttgtttaataattgtattctaacgtaaataaccgcaattagcaactaggcttctgtcgcataccagtcgtttgaccaatcgtgaatagcagccattactggcgctaattcttcacctttagtggtcaatcgatattcaatcaacgcagaatcatcactggtaatccgcgcaacaatgccttcttgttctagttccttcaatcgttcaaccaatacgcgatcactgcacttaggcacactgtgcactaagtttttaaaccgttgtgccccgttttctaataggacatcgataatcaggccgttccacttcttacctaaaattgaaaaagtcttttcaaatttaggacacagttggaaggcctcttgacagtcagcagttgcgttttcttttacaatcaccattattttcacctcacacttattaataagaagtgtactgaaaaaggctgcaaaaagcaacctatcagcttgaagcatctttacttgttaattgccggtgtttggcggagaactttttgtttaaatttcgtccacattggtgtacaaaattccgtcacagcacaataatcatcgactatcgatacaatgtaactttccttatatttcggacgactaacagttgcgccccacatgtgtttaacgatgatgtctttttctttaggtgagagttctgttaatttttcggcattccgaagcgcaatgcgcggatggatataagcatgtgtgcctaaatcgaacttcgtatcacgccagtcataatagaataaatcatgtaataagcccgcgcgtgcaattgctcgcgtatcaagatgccacttcttggcaagttcataactgcgataagagacgcttagcgaatgttccaaacgatctgaatgatgatgttgcgtatagttcgctaatttttggacttcatctttagctaataaatcggcaattagagccatgtaatccgcgtcatcgtaccattttgctgttgaattcattcaaagactcctgacattttttaaattcaaattctgccacaaggataacagcttttcgttcaaaaaagaagttaaacgccttaaaaagttacgtttgttagaaaaaattaagaattaagcttcaatcaacttgaacattaaaatcccagctgcgactgccacgtttaatgattcagcattccctggaattgggatgtaaatattttgcgttgtggctgctaagacgttttcattcacgccgttcccttcattacctagaatcaaggccatgtcatttgctttaggcacatcttgataactgatggcctctggatttaattccgttccataaactgggacgtcttgcgaattgaatttcttcatccagtccatcaagttaccttgataaattggtaaatggaagtgactgccttgcattgaccgcaagagttttggattatacaagtcaacactgccattgcctaaaacaacgccggcaaagtctgctgcgtcggctgtccgaatcattgtgccgatattaccaggatcttgaacagcatctaataataagtaacgacccgttaatttttctggtaccggtgtttcagacatttcaacaacggcaaaaatgccttggggtgctttagtttcactcaagtgttgcgccacttctggtgcaatttcaaaagtttcatcgtaaagaccgcgcaatgcgcgttcgtccacatatttttcagtggcgaaaacttggcggatgacggccttattttggattgcttcttggactaaatgccagccctctagtagatacgtattttctttacgttggtttttcttaacggttaatttcttagccgccttaattttagtgttttgattcgattgaatgtattccatgttgtgctccagtctatttagtactttctattatacgcgacttagtgggtaaattctatcaagggtcgctttttaatcgccaaatcgggttgaacagcttacaatgaagaggaggtgatgacaatgcaaaatgcaattcaacttgaagtctatggccgcgtgcaaggcgtcggctttcgctggatgaccaaattggtcgccgataaactccatatcacaggtaccgttgccaatcgtgacgacggctccgttaaaattattgcgatgggcccagcagacgcactcgaaaaatttatcggtgctgtcaaagcttctcccacccctagtgggcgcgtcgaccgtgtcattcaaacaccactcgaaaatgtgtcagcgtgtcatgaattttcggttgtcagttgaaaaacctagccccttcaagtatagttacacttgttgaaacttatcttgaaagggctaaatttatgaaaaattctaaacgcttcgcgacactcgcgatgcttacaatgaccgttacattctttctcgctggctgtgttccacaaaaaatgagcagccatcccaaagtcccaaccggcttaatctatggttcatcctataaatacatcgccgtgccgctccaacatattatggaacgcattgctgatgttttcggtggcatcaatggttacggctgggcaattatcatcatcacattcgttgtgcggatgattttactcccattaatgttgaaccaatcgaataagatgacggcccaacaagaaaagacccgtcgcttgaaaccgcaattagatattatccaagaacaacaaaaagcggcaacaacccctgaagaaaaggctgaacttagccagttgatgatgaaggtttataaggaaaatgattcaagcatgatgccaagtcttggttgtttaaccttattaattcaattaccaatcttctctggtttgtatcaagccatccaatactcacctgaaatttcgagtagccacttctttgggatcggtcttgggaacccaaacattatcattactgtgattgcgaccctcttatatgtcggtcaaagtgcactttcattagtcgggatgcctgctgaacaaaagaaacaaatgcaaacaaccgtcctaatgagtcctgcgattacattcttcatttcgttatttgcaccagccggtttagcactttatttcttagccggtgggattatcatggtgattcaacaattaatcacgacattcatcatcatgcctcgtgttaaaaaacggatcgatcaagaaattaaggaaaaaccaatcgtcacggttgtcacaaaagaaatgttcactcaaaaagcagcagtcaaaccagctgccgacgtcacagaaacaccaacagaaacaagcaacccaactgtcgctacacctaaagtagctggcaaacgcaactcaggtaagcaacggcataagccacaagcttaaccaacaaaaaaaagcggtgcgcctcaatcaattagatgattgaagcgcaccgcttttttaatccgtattaactggttcttctgattttggttctacttcacgaatcagtggtaactcaactctaaaaacagaaccgtagccaacgctactttctagcgacacattcccgtcatagccttcaacgagttgttgggcaattgctaatcccaatccattgccacctttttcccgactccgtgctttgtcaacgcgatagaaccggtgaaagactttcttcttatcttcttctgaaataccttcaccaaagtcttgcacggccacttgcgcataccgctcatcactagcgacggcaatatgaacttctttacgtatcgttgaatatttaatcgcattatccaacagaataatcataatttgttctaagtgatttcgattaacatgcactagcgctggttggtgcaaatcattgtcgagcataaaattaaattctggatataacatctcgaagttatggtaattctgaagaacaacttccccgacatcggtcacttcagtcgttccttcagtcacgactttatctgcccgtgttaaatcaagcatttcttgaattaaatttttcatccgcaagatttcttgtaacgaagccgctaaagattcttccagtacctctggatcatctttcccccatcgattgagcagttgtagatgcccttcaataatcgcaactggtgtccgcaactcatgcgaaacatcactgacgaactggtcttgctgttcgaaataatgctgaattcgattcaacataccattaaacgcactgaccagatcagataattcgtcttgactatgcccagtctcaggaattcggacatctgaattaggctctgaattaatggcttctatcgtttttttcataacttcgattggtcgcaagaattggttggctaataaatagccaatcaatgcactaaataacatagcaaaaaagacaaccacaactaacacaattcttaattcagtcatagcgtggttataatcacggacgttattgaccacctctacataaccaattacacggttttgacttgtcttaatcggactaatgccaatcagccgcatcttaccaaaaatagctttgcgctttaatgtatccgtatcgccttttggaaacggaccaatcgccccgcgcgatgcaaacaaacccttcttgtttgcatcataaatcttaactgtaacatcctgttgtgctaaccgcgttaaaaccgcatcttgatagatggctttagggctgtgacggttcggatccaattgattggtgacaaagccttctgtaagatgtggcccattgctggacaatctcgcttgtacgacggtcaccgtatcgtgcacattatcgacttctctgtgtagcaagatattagagatactactaaagatcacaattgaaaaaatcgcaaaggtgataaaaatggccaacccaaccgcagctgcccatttcacctttaacgatattttacgacccttatttgttgttggtgctaccgtttcgtcctgcatcacgagcgcatcacataacccattccacgaaccgtttgaatgtaactttgttcgccagaacgatcaattttatttcgtaagtaacggatataaacatcgacaacattggtttcaacatccgaatcgtaaccccaaactttgctgagtaagacatcgcgtgccaaaacaacgttgacgttttccatcaatgttaataataattcatattcacgtttcgttagttcaatcacatcaacaccacgccgaacaactcggttttctttttcaaccgttaaatcacggtaagtaaccgtcgtttgtttagcagcgttatgttcgccttcgatatcaattcgccgtagcaatgcccgtaaacgcgctaataattcttcaatggcaaaaggcttaacgatataatcgtctgcgccatgatctaacccagaaacacggtcaatcactgaatcacgagccgtcatcataatgattggcgtattcttaacttggcggacccgacggcagacttctaacccgtttaattcaggtaacatcaagtctaataaaatcgcgtcccattcttcattcaaggcagcttctaaaccagtacgcccattgaaatggacctctgtctcataaccctcatgctttaattcaagttccacaaatcgagctaaatttttctcatcttcaataatcaatatgcgactcatttagtcactccccaaaaaagaatttttaatggactctctaaattctaatcaatgataagaattctctaagaaacctcaagcgccaaaatcggcttacctttccattttagcatagttccaattaaataactaactaatctgactctcatctgatggcgatttagtaataatcaaaaaaacacctgcgccttaataatcggctcgggtgtttagagaaacgtgcttcctcgaactgtcttttccggttaaccgtaaaatgatgcttatgactaagaaccgccataagcatcatttttctgttaatcctcaaagccaaaaacgttcgactcatcattctattttaaaacgcgcatcccgtcgcggccatttccgcttaatctaaaattgccattaatcctaaaaccgggattaatggcaattttttattaatgctcaatgactaaatgcaacagtcagcactcttgtactaaaacgtgctccagtagacatccgcttccggttagttacataccgcaaacgatcggtttcaccgctcatttacgatattccactaatcctcagcgcatccccgtctacttgcgcactctattgttctttataccaagtataatggaatgtgccttcgcggtctgttctttggtatgtgtgcgcaccaaagtagtcgcgttgtgcttggattaagtttgctggtaatacttctgaacgatatgaatcaaaatatgtgatagcagctgagaaaccaggtgctggcacaccttgttggatggccattgcagctacgtcacgaacagcgccttgataattctttgtaatatctaagaagtaatcatccaacaataagttgtttaaatcagcttttttatcaaaggcatccgtaatcttttgtaagaaacgggcccgaatgatacagccttcacgccagatcttagcgatttcgccatagtttaatgaccagtcatattgatctgaagcaacccgcatttgttcaaagccttgcgcatagctcatgatcttgctgaagtacaatgcttggcgaatcttttcgattaattcttttttatcttctgttaatttagcaacggttggggctggtaaaatcttgcttgcagccacccgttcgtctttcattgctgaaatataacgtgcataaacagattctgtaatcaatgattgtggcacacccaattcaagggcgctttgtgaactccacttaccagttcctttgttaccagcagcatctaagatgacgtcgacaattggtttatccgtttctaaatcatcttttcgcgttaagatgtccgctgtgatttccattaaataactgtctaattcgccgtggttccattctttgaagacatcagcgatttcttcaacagataaaccaacaacgtttctcaataaattataactttctgagatgagttccatatcaccatattcgatcccgttgtggaccatcttaacatagtgaccagcaccgtttggcccgatgtatgtgacacatggttggccatcttcagcctttgctgacatttgttctaagattggtgcaactaattcataagcttctttttgaccgcctggcatcattgaagggccttctaatgcgcctaattcaccaccagaaacacccattccgataaagttaatgcctgacttatctagttcagcattccgacgaattgtatcgccaaagaaggtgttcccgccatcgattaaaatatcacctttatctaataaaggtaacaattcgttgatgacagcatctgtaccagcgccggctttaaccattaagatgattcgccgtggtttttctaatgattgaacaaattcttcaattgtatagcttggtaccaatttcttttcgctgtgatcttgcatcactgcttctgtcttagcacctgttcggttataaatcgcaacggtgtaaccgcgactttcaatgtttaatgctaagttcttgcccataactgccatcccgatgacaccgatttgtggttgactcatgtaaaaggcctcctaaatgatttctaaatttaagcgttgttgactatcaaaacgacaacgcgtctactgtgtttatgttagcagaattacgctttaaataaaagcattttaactgatttggtccggtccatttaacaaattgggtataaaaaaacgccaaacttagtcggcgtcattgttttgttcttctaataattgtttaagcttagcaaattcaggattgggtgccgtttcttcttcagcctgttgcttagcataggcttcttcagaaatgactgaccacgactgtccggctggcatcacatcatcttgttcttcttctggtgttaggatgtgacttggaatgtgcaagagaatgtgatcttcaacagctacctgtagctctagggcttcgccttcgattgggaacaaaatatcttcgtccgtaaatcgtcccaactgctcgtcttctggatcaacgtagatttcagtgaattcaaaatccattggcaaggctactggatctaaactccgcgttgaaggcactgttaatgtcccgaccacatgtacgcgtgcaattacagcgcgctggtcaaccgttaattcaccgtctactacaaatggtgtagcatctaggacatcagcttctcttttttgtaaactttcttttaacatcaatgtttctttaaacatcaatggatgatcacgatgttttaataatgattggactgtccattttaacaatgctcgtcatcctttctttggttaaaaatcggttggcgggcaaaattctgtgattgccagccaaactgttcttgtaatcgatcaactcgcacctctaaccccagtgggccctcttcggcacccaatttagctgagaccttactgataagtggttgatcgagcgtttttttcaacgtgtgcaaatgcgcctggccgacttggttaaagccaagcaaatggacgggccgctgcgctaatgattgttcaatatccgtttgttgaatattcaacaggacgtataaacaaacccgttgcaagcgtgcatacgtatatcgctttgttttaagtgcctgtaacaactcggcataccgattgactgaatgaatcacctttttgaaacggtactccaagccctctgacatctgataaatctgccgaagttgggcaaggggtgtactttcaattcggtatttcaatagcggccacagttggtcccaatccagatgcgattgagtctggagcgctgttaaagtcgaatgcggcatcactggggctaactgtgcccagtcatcaccctttgttgccgcctgtcggatagcactggcactagcaaattgtcccgcgccaatcgtttgatcgccgtgttgtgcctgctcacgcttaatcgcaagcaactgcattggcacttcaagttgcgcgttggcaaccgcataactgacccctaagaggtgattgggttgatctaaatttaaatttaattctgcttgataaaactcattgagctgcgtcgcataagttttttgataatcaataaacgtctgtgacttggcctttaaagctaaaatctgttgcccgacttgctgatagtcaaacgttggatattcactgccaaacgctaaggtctgacaaccaagcgccgccaataacttgacggccccatcagcaaaacggtctgcaggttggacagcactggcaaacggcaattcaacgaccatatcagcaccattgctcaaagcaagttgtgcgcgcgtccatttgtccaaaatcgcgggttcacctctttgcacatagttaccgctcatgcagacaatcactaaatctgcgtgcgaagctgcccgcgcctgttgcaattgataccgatgtccattatgtagcggattatattccgcaataatccccgtaattctcatgcgtcctccgcctatttcactgcgctaaagaaccaacgcacactatcttcttgaacgacttcttggccaaaatcagcactgactgatacattcttgaacccagcagcttctaatgctgcaacataatctaccaccggataagttcgttcatggtgtaattcattaagttcttgataaccgtcaatctcgtcatcccagataaaaaagctgagatcatgttcaactgaatgtggtacttcacctgcgtaactcgtccacatgaaggccgtttctgccgtcttatcgttatacataaaacctgggaaaagctcatccatttgataaagtgaatgggcatcaaatagaaattgaccacctggctctaaagttcgataaacttgttcaaaaacttgttggacatgcgctaaatctggcatgtaacagatcgagtcgtcaaaacaagtgaccgcttcaaacgtcccaatttcgcctaagtcaagcatgtcgccttgtaataaaggtaactcgacctcggcttcagaagccttttcagaagcgatactcaacatctcggccgataaatctaagccgacaacctctagccctgcttgttttagcaagatggctaaatcaccagccccacaagctagttctaggactcgatgtttattttgtaacgtctgcaacgtgtaatcccgccattgaccatataatgaatggtccatcaaacggtcatagacggttgcaaagctttggtaaatcattcttcatccaaccattcggaaacatcaacaagtggtgcttgatcccaaagtttttcaaggttgtataaggcacgttcttctggcatgaaggcattgacaacgatatcgccaaagtccatcaagatccaacgtgaaccctttttaccttcgatgtgttttacgaaaacgccattttcttcttctgcgtcttcaatggcgtcaataattgcgcctaattgacgttctgacgtcccagttaacatcacgaagtaatcagctaataaactgatgccttccatgttcattgcgacgatgtcttctgctcgtttgctatcagctgcttgcacagcaatttttaaaatatctaaacttttcactaaagttctcctttatttggcttgagtcggtacccaagcattgtatgtgtcgattgttttcggataaatctgcttcttgccctgaattaaaaaggtcaatgtatttaagatttcataccgcacgccggctgctaaatcagccattgctgtctcacgagcagcttctgcgcccggaaaattgcgcccaggttcgacaaaatccgccacaaataaaatctgatcaatcaaggtcatttctggcgcaccaatcgtatgacgacgcacagcatttaaaatcgtttcatcatggatttctaaatcacgttcaatgaaataagcaccaacaacaccgtgccagatggcattaccgtaattgagtagttctggatcaaagccttgcgttttaatcgcttcaatgaacgtttcatctggtaattgcttagcatagtcatgcactaaaccagcaattgccgcgcgttcaacatctgcgccatttttttgtgctaattgaatcgcggtggcttccacacgcaaacaatgttcaaatcggctttcagataagttagcggcaactttagccactaactcagcccgtgtatacggcacgatgttttcttgataaacaaaatcactcatgatagaggccctctttttgaatatattcaaagactgggtccggtaacaagtaccgcactgaacagccttgttgaatcttattgcgaatttgcgttgaactgacatcaattaccggtgcgtccacccataagactggatacggcgtttgttgagcataccctgttcgtttaacaccaacaaattggactaactgcactaaatcatcaattcgataccaagtaggcaagtagtcgaccatatcaccgccaatgatgaaataataatcgatttcagggtgttgttgttttaatgccacgatcgtatcgtaggtgtaactgacaccgccacgttcaatctccgttaaatcgagttcaaaatgcgaattgtcagcgatggcacgttctaccattgcaacacggtgttttgctggtaatgtttttttctcatcaacgtgcggtggattggcatctggcataaacaaaattttatcgagaccgagttggctacgaacttgttctgccatcactaaatgaccgatgtgtggcgggttaaatgtgccccccataatgccgacttgcaagcgatggccatcttctacaaccaacacgtccggttcagtcacatgatttgtctgctttagcgttgcactttgcatctgatcaccgccttattagcgtccgagcttagtaacaatcgttgaaatcttttggtatttttctttccgtgaagctttataaatcaccaatgtgcgtccaattttttgcgcaatttcgatgcgactgtcatgttgttttaagaagttggctaattcatcaacggtcacttctgttgtttgtaacaagttaatcttaacgagttctcgtttttcgatggcctcttcaatttgttcgaaataagtttggcttaagccgtttttgcctagttgaaaaagtggtttagtggtttgcgctaaaccgcgtaagtaatgtttttgtttgcctgttaacacgtgcgatacttccttccctaattaaattaatgctttccgaatcatgactgagacacctttaggcgcatatcccgcaaccacgacattttctggtaacgtaatccagcctaacccagcaaacactaaatcactcttttgctttgttgagaattcataccgttggagttctggaaaatcagctaaatcttctggatgtggtggctgtagcatgtcccctaattgcttagcgtagaattgatctgcattttcaagtttagtccggtgaatgtaaagttcattgtcaaaataaccgacaaagccatgccgtgccccttgaatgaaatcaaaacgagctaacccacccaagaacaatgtttgttgttcatttaattggtatacttttggtttaatccgcttttgcggcgcaatcaaccgtaagtctttatcatgtaaataatgcgccatttgttgggcatgcataatccctggtgtatcaatcaatgcatgatcatcttcatacaatggaatatcgatgcgatctaaagtcgttcctgggaattgtgacgtcgtaatcacgtcgctatctaaaatcccagtttgcttgataatgcggttaatcaacgttgatttaccaacgttcgtcaccccaacaacatagacatcgcggcctttacgttcgcgttcaatcacggccaataattcatcaactgaattcccttttttagcactgaccaacatcgtttcaaccggatgtaagccatgttctttcgcttctttttgaatccaattgatcactttatttgggttaagagcagatggtaagatatcaaccttattccccactaaaatcacggggttatcgccgataaaacgatgtaaccctggaattaaactcccgttaaaatcgaagatatcgacgacgttcacgatcaacgcgtcactgtcgccaatttggttcaataaggctaagaaatcatcatcatttaatttgatatcactgatttcgttgtagtgtcgtaatctaaaacaacgttggcaatacaattgacccgtttccaagccttttttaagcgctgaattaggcgtatagccgagtgcttctttgtccgttgtttggatgcgagcgccacagccaatacaaaatagttcttcctcagtttgttgtgtttcagtcatttaaatcctcccgccaagttaaatctgcgtgtttttttagtagttgttgcataatatatttttcaaagaatcgattaatcgatgtattccaggcatcactgtcaataatgggtttgaccaatatcgtccggacgccagccacattaccggcatgcatatcggtaatcaattgatcgccgaccatcaccaattcatgtcgcgaaaggccaagctgcttcttcgctttggtaatcccagttgccaatggcttgttcgcccgagcaatgaatggtaattgcaattcactgagcgcgcgttgcacgcgatcatggttgttatttgaaacaaccatcacggtgatttcggcagcttgcatctgtgctaaccaagcttttaactgtggtgtgccatcggggttattccacgcaattaacgtattatctaaatccgttaaaacggccttaatcccttttgccttaagttgttctggtgttaagtcgtagatggcattgaccatccaagttggcttgaaattctttagcatgtactgtcccctcgactttaatgtgctttcatcaacagcttcttgcgctttgctacacttatcaaatcggcgcttgcagcgccaactcgctaagttaggcaaatgctcggaagctaaccgtggatgacgcacttcttttctttaacgtgcttttcaaaccatattcctgtgcctagcgacacaagtcaaacgattgcttgcagcaaccattcgccttgttaggctggtgctcggagtataccaggtttgaacgcacttcttttctaacgtgcctcagtaggcatatttctgcggctagcgacgtccgtcaaacgaccaacaagttggtcattcgccagactgggctagtcctcgaaatataaccgcctactgacgcacttctttttaatctagtcactgattaattatagggtatttgacaccaaattgcacctttacgcggttaatttccataatttccaactaattcctaatccatttaaatccataagtcaaactaatcgacttttagccccaactctggtacgtttaaagaaattgagaggatgtgtttgttatggaaaaattcggttttaatcactttggcggccctgacgttttcgaacgtttcgatcagcctcaaccaactccaaaggacaaccaagtcctcattaaagtgctcgctgctggattgaatccatacgatgttgcactacggaatggttcacaagattcagtgcgcccattacccttcccaatctttcctggtacagatgtggttggtgaaatcgttgaacttggtgctgacgtcgatgattaccgcgttggcgaaatcgtcatcaatcaccgatcaatgggtgcttatagcgaatacgtaacggctagtactgcgaagattctccgtaagccagccagcatgagtatcgctgaagcagccggtttacccagtgccggcatcactgcttacaatacgctgatgcacttcacaaactttacacacggcgatacaatcgctattatgggtgccagtggtgccgttggtagtttactcgttcaattaagcttagcagctcatttaaacgtgattgcaattgccaatagtgctaacctagactatctgcgctcattcggtgtccaagaagtaattgcttatgatcagccatctgacttcgaacgacttgcgcagaccgctaaaatcggtatcaacttaagtcgcgatccagaatcaactgaacgcctcaataacttagttgcaccaggtggcacattcacttcaacgaccatcttaccaacagacgatcaacaacgcgctgacatcaattaccaatctgtctatccgcgtaaggattatgcagatttaaccgccttacaagatttaaatgaattgatcgatcaaggtttactacacaataccgtcttcaagacgctcccatttactttggagggcattattgaaggccacaagctccttgagagtcatcatgccccaggtaagattgttattagccactaattttataatgataaaagaaagagtctagaacaaaacgaagttttgtcccagactcttttttgatctttaattatttgtttaatgcagctttagcagcttcaacaactgatgtaaatgcagcagcatcgttaacagctaagtcagctaacatcttacggttcatgtcgatttcagcgactcttaaaccgtgcattaattggctgtatgagatgttgttcatacgagcagcagcattgatacgagcaatccataacttacggaagtcacgtttacgttgacgacgatcacggaatgcataacggtatgaaaccattacttgagtatttgctgatttgaataataaatgtttagcgccgcgataacccttcgctaattttaaaatctttttacgacgtttgcgcgtcactgttccacctttaacacgtggcataagaatttcctccttgaataacaaacaacgtcaaagcgttgctgtactgatctaatttttgcttgaatccgaaaatgctatggcttatttaaggcctgataacatttgacggatacgtctcatatcgctatttgaaaccattccagattttcttaattgacgacgttgtttcttagtcttgccgtggaaacggtgacttgtgtaggcgtggctgcgttttaggccgccattacctgtacgtttaaaacgttttgctgaagcacggtgtgtcttaaattttggcatgatatttcctcctaataaatcagaaacagattttttatttttggtcctttagcggttctaacattaagaacatgctacggccatccattttaggacgtgctgtaactttagcgatgtcctctgtttctttagcaagtctttccaatacacgttgcccaatttctttatgcgtaattgcgcgccccttgaaacgaatagaagctttcactttatcgcctttgccaaggaacttacgtgcattgttcaacttagtattaaaatcattttgttcaattgtgggactaagacgaacctctttgaggttaatggttttctgcttcttacgagcgtcacgttgtttcttttgaagctcgaaacggtacttaccatagtccataatacgagcaacgggtggttttgcgtttggtgaaaccaaaacaacatccatattagcttgatcagctaatgcaattgcatcttgagtactcttaataccaagttgttcgccatcttgagcaatcaaacgcaattctcgtgcacgaataccatcgttaaccatcaaatcttttgctatgactcttcacctccataaagtttagagagaaaatgcagctaagtaataaaaaaagcggccctctcataacagaaaggcccgcttgttcggttacttagttcgtccgaattagaaactatcagcccagagacatcaagtgtctactaaggcgagaagcgggaacttctgctttatttctcaacgaaaataagtatacccggttaggaatttaaagtcaaggaaatcccgcatttaaatttacgtgtacttagttgccgtaatgattgtccactaagtgcgtggcttttacttcgtcaatgttgtgtgtaccagctaattgcatgactaattctaattctttttgcaagtagttaaagacactttgtaccccttgtgcaccgccaagtgctaatccgtaaatgactgggcgcccgattgcaacgatgtctgccccttcagccaatgctttaaagacgtgttgaccacgacgcacaccactatcaaagacgattggtacccgtttattaactgccttagcaacgacgtgtaatgaatcaaaggctgcagggccaccgtctaattgacgaccaccgtggttggatacccaaatccctttagcaccagcttgaagtgcaatttcaacgtcttctgctgtttgaatccctttaacaaagactggtaaatgtgtgtattcagaaatgaattcaatatctttagggttcaaacgttgtttagctgatttgtagacggcatccattgtttggcccacacctgtttggcaagcttcaacgattggtaacccgactgggaatgtaaaatgattgcgtttatcggtttcgcggttaccaccaactgtggcatcagctgttaagacaatcgttttaacgttatgcgccatcgcttcgtctaaaatcttacgattgatatcgttgtccttactcatatagagttggaaccattgcggtgcgccatctgctgcggttgccatatcatcgatacttgctgacgcaaatgaactcatggttaagattgaaccgtaatcagccacgcctttagcggttgccgcttcccctttagtattcactaacttatgagctgcaacaggtgccataatgattggtgatgttaagtgatcgccaaagatttcggtagttgtatctggattttcgatatcttgtaaaacccgtggtgcgatgtatttgtgattaaatgccgtaatattttcattaatggtataaagatcacccgcgccactgtaaatatacccaaagccacccttgggaacaacttcgccggcttctttttccaagtcatagaggttaataatgtccaatggttgctctgctgaacctgcttgatatttttctgtcgtcataataacgcctcccattaatcaacgattggaatcgtttacatatttattataccgcttttttagttgtgcgcaattaaaaaaacaaaaaaacgtccgaaatgtcaaaataacatttcggacgttttaataaccgcttataggttgattgttttgtgatctttaccatcgcgactgtagttaccaacttcagcaacgattgcatctacaaacatatctgaagcttcttcagcagcgttttcttcaccgtatttacggacagaaaccgttgcgtcagcaacttcttgatccccaacaactaatgtataagggatcttgcttgtttgggcttcacgaatcttataacccatcttttcattacgatcatcaatgcgcacacgtaaaccatgtttgatcatcgcatctttgacgttctttgcataatcataatgtaattcattcttaacgggaataatcacagcttgagttggtgctaaccatgttgggaaagcgcccttgtagatttctgttaagtaagctgtgaaacgttccatcgttgatactaaaccacggtgaatcataactggacggtgcatttcgccatcttcgccaacatattgtaattcaaaccgttctggcaacatgaagtctaattggattgttgaaagtgtttcttcattgcccatagctgtcttcgtttgaacatccaacttaggaccgtagaaagcagcttcgccttcagcttcaacgtaatctaaaccaagatcatccatagccccttttaacatcgtttgtgctttgttccacatttcatcatcagcatagtacttttcggtattagcaggatcgcggtagctcaaacggaatgtataatcgttgatattgaagtctgagtacacttcaatcattaatttcaaaattgacttgaattcatcttggatttgatcaggacgaacgaatgtatgtccatcatttaaagtcatttcacgcacccgttgtaaccctgaaagcgcacctgatttttcatagcggtgcatcatccctagttcagctaaccgaattggtaattcacgatatgaacgtgggtggtgtttgtaaacttggatatgtgatgggcagttcattgggcgtaattcaagcatttcgccatcgcccatatccattggtgggaacatgtcctcacggtagtgatcccagtgacctgattgtttgtacaaatctaagttcgctagaattggtgtgtaaacatgttcataaccattggcaacttctttatcaatgatgtaccgttcgattgaacgtcggatggtagcaccatttggcaaccaataaggcaagcccgcaccaaccttaggatcaacaaagaataagtctaattggttcccaatcacacggtgatcacgttctttagcttcttgacgacgctgtaagtcagcatctaagtcagcttgtttgttgtaagctgttccgtaaatccgttgtaacatcttattacttgatttaccttgccaataagcgccggcaaccgataagagttcaaagaccttaacgtcgctcactttagctagcattggtgctaacccaaaatcagcaaaatcgcctaatttgtaaactaagacttggtctgtttccatttcatctaataatgctaatttgtaagtttgcccagcaaatagtgttttagcagcagctttgtctaagctgacacgttcgattgccccgccagcttggattaacttgctcattgcttttttaatgtctggtaagtcggtcacagctacttgaccagcttcgttttcggtatcatagaagaagccatcttcagttgcatgtacttcgccgaattgcatctcgggataagcacggttcaacgttgcagctaaaacaaaggctgccgtattccaaattgccatcaaatcggttgctttgtcgtctttagtgatgatttcaattgccccatcttctaaaattggttgctgtaaatcaactaattcaccgttcaatttaccggcaattgcttttttagctaaacttgtactaattgatttagcaacatctaaaagacttgttgcttgttcaaatgcctttttggcaccatctggaaaagttaattgaatctctgccattactatccactccttctaatttatcatcaacaataaaaaaagcccctgagacgcacggattgtgcagctcagggacgaattaatttcgcggttccacccagattgagaccccaacattaggttctccaactttaagcgtctttaacggaaacgacccgatcagttgtgttgcctttgaaagtggtcaattaaatgggggtgaaaaactttcagctctgtttttctctctgcgactgttcatttaaaaggtatctttcatcattgattgattctattaaaacacttaattgcttttttagcaagcttaaattcctaaggttgtaggcgccgattctggccgccaacttcaatttcttgtgctaaataacgcacacgctgcatgatgcgggccgctttaacgggttcatctccttggttgctagttgtcaaatgcgtctctaattcagtcattgtgaagtttgaactgaagaaggtggcgagttgttcttgcattcgatattgcaaaataatgccaagtacttcatcccgaacccacgcactcattgcatcagcaccgatatcatcaatcatcagaatcggtgctttttttaccacgttaaccttttctaacacattgttttgcccaattgcattcttcatctccactgcaaatgtcgggaaatgaatcaacgtggtttcaaacccggataacgccagttcgttggcaatcgcacctaacaagtaagtcttgccaaccccgaattgcccgctaaggtacaaggcttggtgaaaatcatggggtgcttgccgataagccccgataaacgcggtagctttgatcaatgcgtcaaatcgattggttggatcgtatgaatcaatcttggcctgttcaatatcgcgcggcatattaattgacttcactcgtgcatgcaaggcagcttgttcgcgctcttgtaataaacttgccgtaggctcataactgacatcgataaaatggttatttaagactaactttggcgcataacccggtgccaaagtggtttgcccattagctaacttcttcttttcgatgacgtattcgtaaattttagcggcactacgcgtgaccgtttcttgtgataagcggtctttgttagcttgtataaatgcttggacatcggaatcgttcaaggcatcttcgaccaatttattaaactgttggtttaacttttgccgattcatgtaatccgtcaaatctttacccatattttccattacgattcccgcccctcacgaatttttttcaacgccacttctagttcatgctgatgctcaggtgtggttgtttcttttggcgcttgataatctggtttagcccatttaggtactggttcttttttagttttgttctgataacgcgtttggcgattgttttgcacctttgccgtctgtttggtttggaaatcgcgaatctgcaaaatcgcatccgctgccgtcttaaccccttgttgagcccactggttcgcaatccgatcgactagcgcctgagtgagcccatcatattgcgtaatgatataaacgaccaaaatattgagcacatcattgttaaagatatagcggttttgcaagtcctttaacgcccggatttcatttttagcgacaaagccgtggttcttttgtttcaagtattcgagataatcaactggcaagtagccctgactttctgttagccactgcaattcctgttcgttaaagccggctttttgccattctttttgtaactcggctaacggtttttgcgttgttgtagcagctagcgtttgccggttactctgacgtcgtgtgtaattgttcaagacgttctgttcgagcgctgccatattaatcgtactgtcagcaacattcatcgtcaagccaatcaaacgcgctaagtccatctcatctagaccatagaaataatggagattaaacaagccctgttcatttttgagaatttgatccgtatcaatctggtattgcgccgttgcatcttgtaataggtcccaatcaaaagtccgcaactcaaccgaggtaaactgcggtgtgctagctgctttttgttgatacattgccttagtttcagccacactgcttggcgcggtcgtcaataaatcgttttgcacatggaaaacggtcaagaaattcttagtgacctcttgataatccttggcgtaaaccggtcgtagcttgaaatagtcacggagttccacaaaccgtgtttcgcggaccgcttcgaacaatgccacacttaacaaatcatcgttaaaaaaagcttgtggttgcaatggcgcatacagttcatacaccaacttgcggccagttccctcatttttttgatacgtccgcattaaaccaagtgcttccaatttgctgcggctgtcataaaaagcaggtaaatcaacactcaacagatttaacaaagtcgcatgtgtttgaaaatgttgttccgtttctttcttggtttgactccataacaaaagatagagactgtaagcaacagcccccatcaatggttgatataagtaagtgacgactgtttgatcgaaatcggtcaaatagttagcttttgtcactgaaaagccgtcttttggactcaaaaaatcaaatgcatctgacatcggctaacccctcttccttaattcgatttcttcgtcttttctttattcatcatttcttgtaattcactcataaagacattcatatccttgaattcgcgataaacactggcaaagcgaatgtaggcaatctgatcaatatctggtaacaagcgcatcacgtattctccgacggcttgtgaagagacttcgttttcacccaatgagcgaatcttattctcaacttcatcaactacttcagtcatttgctccattgtaacggggcgtttttcagcagcacgaattagcccgcgcaataatttatcacggttgaattcttcgcgcgttccgtttttcttgattaccaacaatggggtttgttccactcgttcgaacgttgtaaaccggaaacgacaattctcacactcacggcgacgacgaatcactcgcccttcatccgtgggacgactatcaattacccgcgaactattctgatgacaatgtggacatagcataatgacaccttcttatcttttgattaattcgtttcaaattcaatccaattttaaaacaattagtataacagtagtataacatgccaggcaagcaggctaaacaaaaaatgtatcagtctcaaggtatttcgccttttccaaacaaaaaagcggtcgaacagaataatctgttcgaccgcttgtattacttgttatgacacaactgttgtaacaacgccaaaacacgttgccgcaacattgcaggtgtgccttgattatcaatcacgaaatccgctcgcgcttttttggtcgccaaatcactttgactatcaattcgcgcatttgcctgttctatagtcaattggttacgcgccatcaaacgttgcaattgtgttttacgttcaacgtagacaactgcaacaccatcgcaatattgctcgtagtgttgttcatataacagtggcacatccaacacaaccagcggtgcatctgctgcttgcatctgttgtttaatggctgtcaaaatagcgggcccagtaatcgcatttaactgagtcaaagcctctgggttaccgaagacttgctggcccaacataggccgatcaacttgaccatttttgacaactgcttcgccaaaggctgcttgcaattgtgcctgtaccgatttattagtcgctaatacctgatgagcaacttgatcagcatcaatcaccgggattccctgttctttaaacaatgccgcaacagtcgacttcccactggcaatgccacccgttaaacctagaaaatacgtcattgaaccgcttctctcttaatctgacaccgcggacagaaatgcgtgccacgctgtgctactttaattttctcaatcggagtctggcaccgatcacacggttgccctttcttaccatagacgtgcaacatatcctgaaaggccccagcgtgacccgccgcgtttaagaacgtattgactgttgtcccaccgttattggttgccagttctaactctgtgatgatttcatcatgcaaacgatctgtttcagctttcgtcaataaattcgccggtgtttctgggtgaatctggctcaaccacaacgtttcgtccacatagatattcccaagacccgttacaattttttgatccagcaacagtggtttaatcgcttttttatgtttctgtaacgcctgatagaaggcggttttcttaaacgttgttggggttggttcaacccctaagtccttcaatccagaaacagtgttttcttgacccgtttcaattaataacattcggccaaacttacgtgaatcaagataacgtaactgttgtccatctgtaaatgtccaaatcacatgcgtgtgcttagtcattggtacggattgatcatcaacttcgtatttgccttccatccgcaaatgactcacaacagttaagttttgatcgaaacgaatcaataaatacttaccgcgtcgatcaacaccgataatttggcgtccaacaagaccttcaacaaaaacatcgtctggattactgataattttcgaccagcgaatctcaattgcttgaaccgtcttaccgaccactaattgttccaatccgcggcgcacattttcaacttctggtaattctggcattgtgtgtccccttatttcttaatatcgtaccaagttggtccaaagccactttcaactttcagcggcaccgctaatgaaaccgcagaatccatgacacttggtactaatttttctaacattggtatttctgattctggtgcttcaaaaatcaattcatcatgtacttgtaaaagcatcttggcttgtaatcctgccttcttcagttccgcttgcatcaagatcattgccatcttaataatatcagcggcactcccttgaattggggtattcattgccgtgcgttctgcaaatgagcgcaaattgaagtttttagcgtgaatatctggtaaatagcgacgccgatggaagagcgtttcaacgtagccttcttcgcgcgccttcttcacgatatcttgcatgaattgatgaacacctggatactgttcaaaatacgcttcaataaagcgtttagcttcagcccttgtgatcccaatattttgtgataagccatagtcactaatcccgtaaacaatcccgaaattagttgctttcgcttggcgccgcatatctggtgtcacttcatcagcgctcgataagccaaaaatcttcatcgcagtattcgcatggatatcgcggtcttccttgaatgcctcttgcatattggcatcccccgaaatgtgggctaaaactcgtaattcaatttgggagtaatcagaagcaaacatctgccaacccggttgacttgggacaaacgcttggcgaatcttacggccttccgctagacggactggaatattttgtaagttgggatcaaccgatgacaagcgaccagtctgcgttaaggtttgcaagtaacgcgtatgcaccttattatcttgatgaattgacttcaataatccttcgacatacgttgactgaatcttagcgatttggcgataatccaagatggtttggacaattggtgcgtcttttttaagttgttccaagacatccaccgccgttgaatagccggtcttggtcttcttaatcactggtaaccccatcttttcgaatagaatgacgcccagttgcttaggcgaattgatgttaaacgtttcgccagcttccgcataaatcttttcttccaaaatcttcagcgtttgactgaactcgccccccatttgttgtaggcgacttgcatcaactcgaatcccggtgatttccatatccgctaaaactagcgctaatggcaattccatatccgtgaataaatcgaattgttgatgtttttttaattgttctgtcaattgtggtgctaatttgtaaatagctgctgctttttgaatcagatgttgataaagcacggttggatcgacaggaactgcgcgtttagcccccttgccataaacagcttcatctgtttggacattttgatactgatgtaaatttgcaaccgttccaagatcattactgttattcgttgtattcaacaaataagacgctaatagtaagtcaaattgaacccccgctaagtgaatccctaagcgattcaccgcaacctgattgcgtttcacgtcaaaaactgctttcggacgtttagcatcttctaaccacgtttttaaaaccgattctgtcaagagtgttacgtcgtcgctgacataccagtggtctggtcggccaatgtaaaagccaatcaagtctgctgtatggtaattgtcggttaacatttcgatgccaaacgcaacgttttcagtggttgtcacgacatcggcgatgttatcaagggttaatactgtaaattgatagtcttcagtagccgtgggttcaactggtgcaacatctaattgatttagaaacgacttgaagttcatttcttggtaaaaagcaaccaaagctgccatatcaggtccgttgtacaccacatcgtctaagccaatcgtaattggcgcgtcacgtttaatggttgccagtgtcttactcgtgaaagctaggtcgcgatcttcaatcaaatgttctttcaatttactctttttcatttcatcgacatgttcatagacaccttcaatgtttccaaattccgtaatcaatttaagcgcagtcttttccccgacctttgtcaccccgggataattatcagaggtatcgcccatcaatccttttaaatcgataatttggcttggttctaaaccgagtttttcttgaacgtgttcaggggtatacgcttcaatttcattgacccctttaacagtgatgttaacggttgtctgactagtcgtcaattgagttaaatcgcgatcaccagtgacgatatcgaccgtgaaaccatcagcttctgcttgtttagcaagtgtaccaatgatatcgtccgcttcgaaattagcgagttcataagactgaataccatatgctgttaagagttctctaatataaggaaattgttccgttaattcaggtggcgtttttgaacggccccctttgtagtcggcaaattgttcggttctaaaagtggttttgcccgcatcaaaagcaactaacacgtgtgttggttcaatctttttcagaataatatccaacatattcttgaaagcataaatcgcattagtgtgcagtcctgcctgattggtgaaatggtctaaagcttggtgcattgcaaaaaaagcacgaaatgcaacactattgccgtcgactaataataattttttttgagaacccatgttgttcctcctacattcgtaaagtgactagctctattctaacaaagaaagtgacgcgcgtcattatgcgcgaccgttgctaatcgcacaaaaaaaggccgcaacaaatggttgcggccttttttaacgtttattttgcttctgggcgatccatgttcattgatgccatgcgaccaaagatttttttgctttggtcgattgttgcgccaacagtatcttggccgatttcattttgtaaatctttgtacaagtctacgtaatagaacaagagatgacgataaacttccaaacccttttccgtcaaatgaacacgacgaatgcgttggtcattttcatcagattgttctgcgataaaagccatcttacgtaatgaacgacattgacgtgaaatcgctgaacgactcacttgcatcttatctgccaatgcactgttagttgtttcattattcgcattttgaatctcgtgcatcactaaaaattggtcgaaagataaaccgtatttttggctttcacgactcattgattcgctaaggttgttaatcaaccaccggtataaacctgcgaattccataaaatctgctgatgtgctaccgagtaaatcggtgttattactcatatccatttctattcctcctacatgctgaaactttcagtatcaatagttaaccatcgataagtttcatactcacactattcagtacttcaattcttccgttttctaagatagccgatctaaataatacttagtcagctaatcttaaccgtacttcgatttaaagcaatataaatagtctatagtattaaattatatatttcaactaactttcactaataatcatcaacaacgttcattatgagttgccctgacaatctttattaaaggtaatttattatttattttaccaaaacaatccacgaagtaaaaaatacagcctcaaaaaaggctgtatttaaaattacttaataattgtgattgtaatatgacgacgaccccaactcttacatgccgcaacagttggaaaatgaacatcaataatgtgacctttaatcgcgctacccgtgtcaccagcaattgcatacccgtaaccaggtaccaaaacaagtgagcctaatggaatgacactaggatcaacggcgatacaatttgggtttttagttaactcaattccagttgcaccaaaatggctcaaaccaggttcggcagttgaataagccgttgcttgcacttgaatcgcttgtccggccttgccatcagcagcgcttgctaaatcggcttgctgggcatttgtgtccacaactggtgcaattggcgcttgtgctgcttcgtcggccgcttttttagctgcttcagctgctttggcttcagcttcttcacgtgcttgttcttctgctttttctttagcaatttttgcaagatccgcttggctttgacttaaattattctttaagccagccacttgttgttccagttcgacagattgttgatccaaactgcttcgttgttcatcaagttctgtcttgctagcttgtaacttatcttgaatggcttgtgtatcacggtaactctgtgctaattcatccatattatggttgtcagcactttgaagaaccgtcaatgtgtaagcccggttgaagaaatcactcaaagaatcagctgacaatagtgagttgacaacgttgcggtcatcggctgttcgttgaagtgattgcaagcgttccttagcatagcttttacgttttgctaaaatggcttgttgctttttcaaaagcgtttgtgcttgttcgatatttttttcgttatccttaatcttttcctttaaggcattaatttcttgatacttcgcattcacgctcgttaaagtggcttgaatcttcgaatttgtatcatcaatacttttttgggtactgctttcttgggcttgtaattcgctcaaactggcagcactaacagatgtgcccatcgtaaccattgcaactaaacaggtaacaacagctaacgctagttttctaaatcgcatcttgttaaactcctccattcataactcagacttgattatacgcaacaatccccgcaagaagattgcagattaatgacgttatattacagtttgaagacatttataatttttgcgtaataaaagcccacttgtaaccgccaacaaaccaaatacttccaatagaaaaagctaccacaaaagtaaattttgtgatagctttttgactttatacttagattttaattaaaggactaacctttaatccgaactgcgcgggccatttcacgatcttgttcttttcgtttcagtgtttcgcgcttatcgtattcccgtttcccttcaccaacgccgattaaaactttggcaaagccgtgtttcaaataaacccgtaacggcacaatcgtaatccccttattcttcgttaaagcaccaatcttggtaatttccttcttgtgcaacaatagcttccggttgcgcaatgggtcatgattaaactgattgccttgttcataagggctaatatggacattttcgagataggcttctcctttacggacgcgggcgaacccatcacgtaagttgattttgcccttacggaccgatttaatctcggtaccagtgagcactaagcctgcttcgaatgtttccaaaatattataatcgtgaccagcttttttattctgtgcaattaaatttgctggtttttgaggatgtttctttgccattcaatcacctactttttaaaagtacgtttttgtgagtccttgttcgcagctgggcgtcttggatgattgtttttcttttgatcaccacgacgttgaccgcctttttcatgatcacgtgggcgtgctggacgctttggtcgtgcttcaatcttgcttaagatttcagccgaagccaatggcacttcttcaccggctaataattcaaagtccactgagtgggcatctaaatcaacattcgcgaccttgacccgtactggttggccaatgcggaacatcttatgcgttctttcaccgacaagggctaattggctttcaacaaagctatagtagtcatctttcatctgtgagatgtggacgaggccttcaaccgtgcttggtaatgcgataaacatcccaaagctggtaacagaactaatcacagcgtcgtattcattaccgaccttatcaagcatgtattcagccttcttaagatcaacgacttcccgttcagtatcgattgagcgacgttcttcaagggatgtttgttctgcgattggttgtaacttaggtgcccatttttctttttcttcaatcgtcatcccatttgtggcataactatgaatcaaacgatgaaccatcaaatcagggtaacgacggattggagacgtgaaatgcgtgtagaattccgcacccaaaccaaagtgaccaagggattcatcagaataatgtgcttgttgcatacttcttaataacatcgttgtaataatcggttgttcaggttgaccttcaatttgcgtcaagacttcttggagcatcattggcgtcactttcttacttgaaccgtgtgcttgaatcccataagccgtgataaattcaaagaaattcttcatcttatcagcatctggtgtttcatgaatccggtataagaaaggtgcattagcagtactgtaatgttctgcaaccgtttcattagcagccaacataaatgattcaatcatgcgttctgaaagaccgcgttggcgtaattcgatgtcgatggccttgccattttcatcaacgataatcttagcttcgtcttcttcgaaatcaattgcaccacggttatgacgcttcttcaagagaatttcatgtaattctgacatcgtttcaaacattggcacgagccgttcgtattgcgcccgtaagtcagcatcttgatctgttaagatcttattgacgtttttgtatgtcatccgcgctgttgacttaatcacacttgggaaaatcttgtgatccactaccacgccgtgttcattgatttccatttcacacgttaaagcaaggcgttcaacgtctggatttaatgagcaaatcccgtttgataagcggaatggcaacattggaatcacgcgatcagttaaataagtactagtcccacgttctaaggcttcaacgtctaatggtgaaccttcagtgacgtagtaactcacgtcagcaatgtggacccctaagtagtagttgccgtttgccaactttttaacgttaactgcatcatcaaaatctttagaatcgtcaccgtcaattgtcacaacgtcttgatccgttaaatctttacgacctagtttatcagattctaaaaccgtatctggaatcgcttctgattgaagccgaacttcttctgggaagtccgtcttaatatcatgttgatacacgattgataaaacgtcaacgccgggatcattcttgttaccaagtacttgtttggcaatccccagcatttgacctggcgcctcaacacttgggtaaccggtaacgtcaacttggaccatgtcacccttttgtggatgtaacccattatccgttaaataaattcggtaattacttaattttttggcatgactttggatgtatccaatccagcctgttttttctttttggatatctgaataaggcatgaattcgccgacgatttcttcaatcccccgcgtaatcactttcgccacttttccttcaggaccacggcggctgttttcttcggcttctttagtgatggtcacttcaaccgtgtcaccattcatcgcaaaattcgtattgggtggggcgataaagatatctggatcattaggttccttatcaacgattgaaacgaagccaaagccacgatcgttagcatggaagaccccttcaacaaggcggttgctggctggtaatctgaacttaccggcatcgtccatattcaatgtcttatccccttctaattctgctaatactttcactaggtccttgaacccttgtgaaccggcaacgccgattcgttcactaatttcggatacgtttaattgttgcgttgcatctgcttcaaaaattgcaagaatcgctgctttcatctgttcaacttgtgtcacatcaacacctctttctcatttcttaaaacggtttataaattctaggacatctgtttctaattggtgatgcgcactatcgaccgtaatgacgtggccggcttgtggataccaatgataatcaactgttatgttttgttgcgttaattgctggtgtaagacttgggcttgcgttggatcaataacttgatcttggccgccttggccgatgaagaccggtttatctccgatttgcttcaagtcagccacaacttgtcgactgaaaatatcaattgatgcaagttgttgtggtaattgctgattaatggtcgccagacgtgctgtctgttgcgcagctgggacgcccattaactgcatgattcgattagcatattgaccaaagagcggcgtcaatttagcagtcggtccttcgagtactggcgcactaaaaattccaccaccacaaacttgtggtagttcttctaatgcccgcatggcaaacaatccgcctaatgacaatccgaaaacaaataacggttgtttgttagccgcggataactgctcaatcgcagccaccgtatcggcccaccatgcatcgacagaaccgcgcgttaaaatctcggttggatcagccgttgcatgccctgcaaactgtggtgcactaaccgccagctgatttttctccaaaaagcggcccatcatacggacatcattcgcactacctgtataagcatgtaacaacacaaccccgactgaaccaccgtcaaaataaaacggttgcggcaaccgataagacatgcgctcacccccaaagttcttactgcttgaattcatttaaaaaggtctcctgccattcaacaggagaccgcatcaacgttcttattagaattcgacccgtctcacatgtattagtgtgatgataagtacactaaagctaatgcaaagacgaagaataaagcccctaaaacaacggttactttctgcatgaaagcttcgaaaccacgggccttttgcttgccaaataaatcaccagaaccacctgataacgcactcaaagcatcctgttgtttacttggttgcatcatgactgcgatcacaatcaagattgaatcgattaataataagttcaggataagattttccaacctaattccctacctttctatctacactgtcttctaatactttagcataaaaagtagttaatcaccacttttttatcgattatttcacgagattctcatccgtatttcgcaaggcttgggcagcatcttcaatttgccgccgcaccgtcgcccgtagctgatgatccgttaacacaatcaacgtgtcaccagcacgaatcaacgtatcaccatgcggaatcagttcggattcgccacgaacaatcgcaattaacaaacatgtctttggccagtccacttcacggacttggcgatcctctaatggtgcgcccgcaaacactggtacctccaagcgatcagagaatgttgctaacttgcgatgtggtttgccaagtgcgcgttgcaataatgatgcgtaaattggcgcgctccccattaagtcgacgacgatgtaggccaccaacgataaaattgctagtggcatcaagtgcacgagtgaacctaccatctcggtcactagtagaatggccgtaaatggcgccttcccgattccggcaaagtaaccacccatcgcaaaaataattaagttgggaacataaactggtgctaaccaaccaagttgaaccattatgagtccataaagggcaccgattaaagctcctagtgacaaaatcggtagaaaaatcccaccaggtaatcctgaaccgtatgaaatcattgaaaaaacaaaccgtaataggaatagaccggccaccacactgattgttggtaaattttgtccaaggtgtgcaatcaatccattgccaccacccaaaatttcgggccagaaataaccaatcggcaaaacacataataatggtactaatccggtatacgcttttggcagcgggatcttcgcataaagttgcggtaaccacaataataccttctgataaacgtatcccaacaggcctaatacgacaccaagtatcaacaaatgccaatactgattaattggcaaactctgggagtacgtaatatgtaatgtcggtgtcaaaccaaaaaaatttaatgaaatgaagttcgctgcaattgcgctagcaagcgacgtcacccaaactaacggtgaaaagttatggtagatttcttctagtacgaaaaaggtcccggcaattggtgcattaaacgcagccgataagcccgcggcagccccactagcgattaaaatccgacgatcagcaccgcgattttccaacttagcggcgaccccttgtccaacggcagcccccagctgaatcgatgggccttctcgtcccaagaataagccaggtgcaatacttaaaatgcccccaacaaatttacgccacaggattgaccaccaattgaaatcaaactcaccttccaattggccttcaacttgtggaatccccgaaccacttatattcggttccttttttaataattgtgccacaagcaggccgatcaataaattggcaccaaccaatggcacccaataccacgggtgtgcatttaacccttgatagatagtgataacaaaggccagtcctttttcaatcgctaagcgaaataaactgaccaccaatccagtgaacgccccaactaataaccctttgcccacaaagcgaaaccgtgtcttattaaactgactagcacgtctaagtcgtccattttccacgtttgcctaacctccatctgataatgctttatatacagactaccacggaaatggggattatcaaatgttgaaaccaaataaaaaggcgagcactattgctcagcctttattgatagatatcaattttgtatttcaatttaatttcataaaaaagcctttagattagtttacctggtttcgctataacccatcaatcagctaccaacgttttaacttgataggtaccgctattgtgcataacgtttacccgatacgttttacccgaaactgttaaacgcgttggtgtaaagacattgccgcttaattctccctcaaaggcctggccagacactattgtccctatgctgtggtcttcttccatgataagaatcgtatattttttgaataggtcatttgcaaaagtcaccatcattttggcatctttaatcgttacatccgcaataagcgcattcaagaataactgttgtgcctccttcatttttttcgctagcgcttccttgctgtcttgtggtaactgatttacttgctgccatgcttgatctaacacttcttgcgtcacatttggtttcaacttaccgtcctgttcaaataaatccgatactaactttctagcaacaagcacctcttgactaatcactttcactagataagtgccatgcggtaaagtcaccgctatcgagatcgcagtggcatctttttggtttggaataatcaattgatttccttcaacacgaccaacattcggcttaccattcgttacttgagcaatcgtatgtgtatccgcttgaacttttaaatcgtcatattccttaagttttccatcagcaaatgtcaccacaagttctgattctgaattcagttcaattttaccaactaatacgtctaaatatctttgttggagctttttaaccatctccattaattcttctttatcagtattaggttgtagtgcatcaacctgttggcgcagattgtttaatttatcttgcgttagaatcgtctcgattggttttgttgtgtttaaatagttttccaattgttccctaagcgaagtcccactgatcgattgattaaaccgcttataagtcccattggcattttgttgttcaatggtaatcatatcggttacatcaagtggttcatcaatctgccaaatatcattaataactgtcccattaactggtttcttatcaaccaactccgcaatcaccttgccatttttcttaacaattaatttctgattcttaaagatattaatttgatagtttgttaagtcaactttaatcccttgtttactgagcgacacagccttcattaagctcattggcaattgttttttagtttgattgtcatttaaccaaattgggtcagacaacgttgtgtagttgctgattttcttctgtacttcttcagaaactttaaatccccattgttcataataagggagcatgttatagcccgttacttcagagacatgtaacaaaaaatgctgcattcgatcttcatttgaatcataggctaactgattttcgcgataatactgatgtaagatcgggtagaaatcatcgccaaaagtgtttgctagttgggcaaacattgtcattttgacaaagtccccttgttgattgaagtttttatgatcagaatttagataggcgtgcatttctgggtaatacttatctaaatcaggcatcgcacccgtcatttctttttgcgctgctaacgaataaatattaacactcgattcgacaacttctctccatgtccatggtttttgttgtctctgatggccactttcatgccagattccccaaggatcctgaagttctaataaacttttcatagctgcatcgcctttaaaacccatgtattcgtttgtcgcatacatataatacgatggcgattctaagaaatgttgtaaatggcgatctgaaaagttaaccggccgaccttcattactgatccctgaaactcgatcttgagcgaccaggaatcggtcataattagccattaacgctttgggatcccccaaatatttctttgccatctcataactcacagtaattaaagcacgatcactaacaagttgaacatcttttgcgtctgtcatttcagtcatttgtttcttaaaatcttcgacactcgtcttgtttgcatcaaagaacggcatttcaccagtggcatcaaagattgacaccctagtaccgcctgaatcatttggattcgtcacataaatagggccatcattttcaactgtaatagtcgtcaccccatttacgagcggatatcgtttctgaacatctcgctcaggcgagccaatcgtcagcacgtccccttttttggcgtataatccggaaggctctaagcttgaataactcaaggccctttgttgccgagccaattctttattaacatcaccgcggccaatatacagttttgaatatggcgccttttctgaacgtgttacacccttctggtgcctcaccttaggttggaggctatcatcaagcacctcactttgcttactttggtaattagaactggtcgtagcccttgcttcttgtaaaatactcatgcaactggtcgttaaaatgccgaacgctaaaatacctactacttttttgatagtctcatctcctaaaaaattatttttggaacacatttaacttaacacacttcatcaactccgcctataataaacagataatggtttccataaatattatcgacacataaaatccatattactgcgataaacaattagaccgataagcatacaacacgtattatacaaataataaaaagcattcttcccgctataccaaaccaatgaaaaagtcgtctaaattcgtattttaatccccattataaatcattatttttttatattccaagaaataaaacacgtcaaaaaggccaacgctaaaaatttaacgttggccttttaaaaatgatttattttatagttgcgtactaaaaaaatctgtaattatgttcatcagcgccggcttcaccagatggcgttcaccatttgctgttaaaaatgtcacgtttttggcataagtttgacctttaatctgctgttcaaaagctgctacttgttcatagggtattcgttcatctgctgtcccatgccagaataaaacaggtcgttgtgcaattgtctgcggctgttcggttaaatcgtaggccgttaaccaacttgtcaataaccctaaatcagcgggttgcgttaagtgatgcgcacggacattttcgcggactaatcgcgcataagctagcggtgccggcgagcccatgatgcaagccgccactttaatttctggatgtttagttagtagtgccgccgttgtcatgccacccatggaaacacccccgacgccgatgcggtcagcttggattaaattaagttggcgccagtaatcaacaatcaaactgaattcggcaaggttggtttgaatactttgccaaaaagtccatgacggaatctccgaaacaggttgcagccgttcaccatgattcagtgcatccggtaataccacgcgtatcccagcttcagccagtttacgcgcttgcgttaaaaccaattcttttgctgaccgccagccatgatagtaaatcatgagtggtaatggctgatgacgttgttcgtcagcaaccacttccaaaactggaatccctttaatctggcgttttaacactaataccattatgacccctcccccattatttcaagattactataacggaagttggcggggttgtcaccgaattagaatttttcgcaaaataaaaaagccaccagattgatttaatcgggtggcttaaatgtgctccagcagtcatattcctgcgcttaaccaaatttgtcaaatagacgatgacatcgtcaattcgccaaatccagttaatgctcaaatataaccgcctgcttgcacactctgatctgaaacgtgctctgtaagccatcttcttccggttagctacactcgtcaaacaactgcttgcagcagttattcgccgagttaggctaaccctcagaagatacccggcttactgcgcactcttttttacattgcttttggtgcttgtacgcctaataagtctagtgaggcttctaggactgtgctgacactcttcactaatgaaagacgcgcatttttttgatcgtcgtctgccaaaatttttgagtttgcatagtatttattgaaggcttttgccaaacgtaatgcatatttggcaatcactgatggttcgtattcttggctggctttcacaatcacgtctgggaagttaccgagcatcttcaagacatcccaagcgttggtatctgaaacgactaagtcagcgtccattgtgacttcttggttggccttgcgcaagatactttgggcacgggcatttgtgtattgcacgtatggacctgtctcaccttcgaaacgcacaacttcttctaagtcaaagtcaaaattatctaaacgatcattcttcaaatcatggaaaataaccgcgccgatgccgacttgtttcgcaacttcttctttgtttggtaagtcagggtttttagcttcaatttgttgttgtgctaggttaacggcgtcatttaaaacttcttccaataagatcacacgaccgctacgcgttgataatttcttaccaccttgagtaattaagccgaatggaatatggtgaatttcgtccgaccaatcgttgcccatttcttttaaaacggccttcatttggttgaaatgttcccgttgttcgccaccaacaacgtacaatgattgcacgaagtcgtatgtgtcatgccgatacatcgcagcagctaagtcacgtgtcatgtagagtgttgcgccgtctgattttttaatcaaagctgggttcaagttgtaagcactcaagtccacgatttcagcaccgcgactttcttgtaagagcccttttgcttcaagtgcgttgaccacaccgtccatcttgtcgttatagaaggcttcaccattaaatgagtcgaattcgacccctaacatcgtatagatcttttggaattcctttaatgattcagttctaaaccatgaccataacttcgttgcttcttcatccccggcttcaagcttacggaaccatgcccgtgcttcatcgtctaattctggatgttcaacgtcttcttgatggaacttaacgtaatatttcaaaaggttcgtgattgggtcttctttaacttcttcttcactcccccattttttataagctacgattaatttaccgaattgagtaccccagtcacccaagtgattgattttaattgggttaaagcccacttttgtcaaaatcttggcgattgagttcccaatcactgttgaccgtaaatggcccattgagatgggtttagcgatgttgggtgatgacatgtcgattggcacgttgccccctttaccgaggtcactttggccgtaattagcggcttgcgttaagacggttttgaggatttggtcgctaaacgtagccttatccaagaagaagttgatgtatggcccgttggcaatcactttttcaaagccggcttgatccatttctgcgactaagtcttgggcgatttgttggggtgctttccgtaatgttttcgctaagataaacgttggaaaagcatagtcccctaagtctgatgtttttggtgtttcaatgagttgtgctactttatctgctggtaaactgtcccctaaaacgcccattaaggcagtggtgacttgttgtttaaaatccatgttgatagcctcctaatatttgtgaacaaaaaaagtcccttccaaataaatgaaagagacgagaattcccgcggtaccactctgattgatcaatcgatccactcaatagtatgcaattgttcaaccaaaagcgcgccgcgtcaacttgattacccaccttacaccgtctgtgagctcgctataaatcgctgttgatgctattcttttgactgttcgaacttgataactagtatatagaacttagctgcacttttcaagcgcaattattctgccgcgagggcttcaattggatctaacttagctgccttacgagaaggtgctagtgccgctaagagactgatgataatgctgatgattatcccgaataggacgtagccactggtaattgccacaattggcatatgcgttaatggttgggccaacgtattgacaagcaattgtccaaggccagcaatgccggcaccaagaacacttgataataatccaatcaagaaggcttctgagacgaataagtgccgaatatctttctttcgggcgccgattgcgcgtagaatcccgatttccttcgtccgttctgacacactgatgtagagcaccacgataatcatgattgctgaaaccaataatgaaatcccggcaatcccagctaagacgtagaaggctaacatcaagtaagtgttaattgaatcgaggatcgcaccaacccctgtgatttggtaatccttttgtgtcttaccgttgactttgctagtgtaggttttgattttattttgaacggctttaacattttgggtcttattaaccgtgactgctgcaaagttgggtgcaaactctaatccttgcgcttggtacatcttggctaatgtgccatatgtgacggcttcagtcccagaattgatgatccctgaaactttcacatcttggcgcatttgaactggacgttgatccttactaatggcattgacgtaaatggttactgtccgaccaaccatcttcttgtaatttttatctaacttcttagccattgccttcgttaaaataatttcgttggccccaggtttagtcccggtcttaatatcttggacacgttcggttttattaaacgtttggaacatttggactgtttcactcttcttttgatagtgcacttggacaccattcatgtagtagcccttttcaaccttcgtcacgtttttgaccttattaaggcggttgatatccttatcagctaagttaccttgttcaccggcttcaatctgtttgcgcgtgaggtttcttgcaatctgaatcgtatttggattaacttgcgatgaaatctgatcattaatatagccagtcaccccttgacccaagcctagcattaaaatgacggagaaaatcccaatggacgcgccaaaaataatgagcaaattccgtttaatatcgtagcgcatgtgttgcattgccattttgaaagcagacataaaacttaatggactactcttcttaattaccggaccagttggagctgggtaagctggttttaattgcttgtcataatcaatctgcccatcaaccatgtggacaacccgtgttccgtggtcagcaacggcttgtgaatgggttacggcgatgacgagtttgccatcttcggcaatcttttgtaagatttcgagaatctcggccgtattctggctatctaacgcacccgttggttcatcggcaatgatgacatctggatcagcagccaaggctctggcaatagcaacccgttgcttttgtccacctgacaattggttgggatgtttatggatatgttccttcaagccaacttgttccaataaggcggtcgctttggcaacccgttccttatgtgatagatcagtcatttcaagtggcaccatcacattttccaagttagtcaaatgactaattaaattaaagctctggaaaataaagccaatcgtttgactccgataagcatcaaatttcttttcggatgcattctttaaagatgtcccatcaacgatgagctccccatcgtattggtgatctaacccaccgatgatgttcagcaacgtcgatttaccgccgcctgattccccgaggattgaaacaaattcgccacggtcaaagcttaaattgatgccttttaagactttaaattcagccttgttcatataataggacttgtgaatatctttaatctctaataatgtcaatgtcgtacgctcccactacttagattgctcgtaagtgtcacgattttttagtcgatagataataaatatactttatcagagcgcctttaaacaaacaatcggccttaggtctgataacgaaaagagtgtgatgtaagtcgggtatccgccgaggattaaatttcagagaataaaaaaagaggttgcaacaaaatttcttctgttgcaacctcttttgcatgaatctttaagcgagtgacgggaatcggacccgcgacgcaagcttgggaagcttgagttttaccactaaactacactcgcattacttgatatagtatagcatattatttccgatttgtgcatattttttgaaaaaaaaggtttaaacgcttaacaaatagcgtatgtatgcggtatactattgataacaacttgattggagtccttttaatggccgattcgcaaaatacaattcctgaatcaaccgcatttcattgccctgcatgtcaggcgccaattgaatatggtatcaaacgttgcccaggctgtcagactgcgatcttctatcgcgatatgtctgaaacattctggaacgatcgtaaattaaatctttttaaacaaacggatgccattcaacggggcaattgacttaaattaactattcaaccgtcactttttgtgacggtttttttaattgttaataattaattcagaaggcgttaccattgttaatttgatagacttcacgactcattttagccgcatttttaatttgaaaccaacggtgatggctgctataatggcacaccatacacaggaggtctttatgatagagaagaacaaaatgagtttatttagcctagtgatgctaggtttaagttccatcatcggttccggttggctgtttggtgcatgggaggcaacgaccgtggcaggcccagcagccatcatctcttggattattggcgcaattgtgattggtgcaattgcctttaattacgttgaactcgggacgatgtttcctgaaagtggcgggatgagtcactatgcccaatatagtcacggttcattactcggcttcatcgcagcgtgggccaattgggtatcattagtcacgattatcccaatcgaagccgtcgctgctgtccagtatatgagttcttggccatgggcgtgggctaactggacgaatcactttatgcaccacgctgaaatttcgaatcgtggcttgctcgtcgtctttgcctttatcatcgtcttcacccttttaaatttctggtccgttaaattcttgacccgttttaccagcttcattgcaatctttaaattaggtgtgccattattaaccattattatgttagtctcaactggtttccatactggcaacttcgggcattcaatggcgacgtttatgccctatggttccgccaaaatttttgcagccacttcgatttctgggattatcttttcatacaatgcctttcaaacagtaatcaatgtcggcagtgaaatccgtgattctaaacggaatattggacgtggaattgcaatttcacttgggatcagtattgtgatttatctactcttgcaaattacctttatcggttctgtttcacccgccttgctcgccaaagtcggctggcacggtttaaacttccaatcaccctttgccgacttagccattttacttggaatccattggttagccgtcttactttacttagatgcgtttgtttcaccctttgggaccggcgtttcctttgtcgcttcatgtgcacggacattagcagcattaaagcagaacaaacacatgccaccgattgtcggccgcatgaacgaacaatataatattcctcgcattgcgatggtcattaacgccatcgtcagcatgctactcgtttcaatttttagaagttggggaacgttagccagcgtgatttcaaccgcaacgttgattgcctatttaaccggcccggtcaccgtcatgtcattacgtaaaatggcccctgatatgaaccgccctgttcagtcaccttggatgaaaatcatgtcgccattatcctttatccttgccagtttggcaacttactgggcaatgtggccaacaaccattaaggtgattggcgtcattatgcttggcttaccattttatttctactatgagtatcggattcactgggaaaatacttgggcccaattcaaaggaagcttatggttaattatctatctcgcattgctttcgctgatttcattcttgggcagttgggaattcaacggaattaacctgattccttacccactcgatttcgtcttaattagcgcattagccctcatcttttactattggggaattatcagtcgcttctattcgaaatacttctcacgcgcaacacgaattaacgatgatgtgcaactttaagcatgactaaaaaggacgccaaacaacggttaaagttgtttggcgtccttttggtatctctagattgtttctgctaaaatgaatcgtaaagtacattatctttttcgggaggcgctaaccaatgcaaaaattgaccgttcaatctactgatcgaatccatactttaaatgtcgtgacttggtttccaatccaaaaaccggtcgcagttgtccaaattctaactgggatggccgaatatatcgaacgttatgatgctttcgctcaattcttagcagatcgtgggattatcgtcatcggacacgatcatattgggcaaggccactccgttcagtccaacgatgagctcggttatttcgggccaaacgggctccagacgctagtcaacgattgtaccttaatcggtcgcattgtccacgaggaatacccagagctaccattatttgtgctcggacactcaatgggctcaatgctagcgacacaatatgttaagcaaactgaagtgccgattactggagccatcttcatgggcgttatcgatgtacccttcattcttaaacccgccttaccaatcgttaaattaatcggcgccattgcagctaagcgccccggtactgtctggaataacttggcgtttggggtctatcctaaacgatttgatgctcaccgacctttttcatggttaagttacaatcaagcaaacgtggcggcctacgaacagcatccattgtgtggctacgtcttttcaaatagcggttttgcaatgctcttcaccctcactgagttaactcggcatgctgattggcaacttgccttacaatcccgcccagttctcgtaatgagtggcgccgacgatccagctggcggttatggtcgccgcgcgcggcatttaacgaaccaattcaaaaagcgcaccgttaacaacgcaacggtgcgcattctacctcatacagcgcatgaaattttattagaaacagatgctacccagcattaccaattcatctacgattggttgactaaagtaatttctgaatctcctttaacacaccatagttctcattagtgtcggcacgataagtcgcatattggatcatatcatcggcagcattccccatcaaataactatgttcaacggtttgcagcatttctttatcattataagtatccccgaaggccatcatttgcgccggcgtgatgttgaaataatccgccaaaaagcgcattgcatggcctttgtcgatgccttgattcataatatcgatccattcaacaccggcaaccgttactgaataagccggttcaaattcgggtgcgaaaacagcttcatactgtgcttgactatcttttcccgggaaataaatcgtaaacttgttggcttcaacactaacctgcgttaaatcaggtacatattcaatgttggcatagaattgccgcaaagtcgcgtcataatctcgatattgtgtttcaacgtacgccgcgtccatcccacaaatcacgccaatcccatctggcgtttgattaacgaattggaccatccgttggtaatcagctaacggcaataaacttttgaataaagttttaccttgataaccaattgcacccccgttatcgctgacgtaaaccattgtgtcagcaagttcgggaaacatttgctttaacgtgtacattggtcgaccgctggcagctgcgaattgaacccctttagcatgtaattgctgaatggttggtataaagtttggtggcaactggccactctcagttaataaggtatgatccatatcggatgcgattaatttaattgtcatgcttagttctctcctatcccttagataccttaataatataccgtttatgccaattcatcgcaaccggttacattcaaaaataatcatactcgacatccatcgcttcgatcctgcccattaacacgcgctaaactaaataactcccccgttcagattccgatagtctctctaaaagatttgaatctcattgatattgaatgttcttttaaccgcgtcggacattagcgcaatttggttatcaatttcatcccaattggtggtaacaaatccagaatccaaactatcaatcatgtcattactgtttagtctaatctttaataataactgtttccccttggttgtaagtcgatagtatactttacgactatcaccaataaaactccccacattagcccgttcaattaatcctttttcacccaacgattggcattggcgggaaatagctggtcgagaaacgcccatacaagcagcaagggtgccgggcgtttcttctttttcacgatccattttttccatcaacaaatattgttcgagtgataagtcaacattttgcaaaactgtgacaaataattgatccaaaatattacgatatttaatgagcattaataattgattattcataataagcattactccttctatctattttgaggacctacaatatgcgaactagtaatcctgctctgctacacaggcattatattatataaattaattaaatgtaaatagctgaaattaacggcattgacaaaaaaatatttttaataagttttaaccctattaatattttttattgaaattcgccaagtttgtgatgtttttatttattaaatgaccttttaatcgcgatgcagtttacagcttgtagctttcagccgtttttatagttcaaataataattatattgataagaaaatatttatttaaagctatcgttttctactaatggtttaattccttaaaattgatgcagctttttttgaatagtgctaataattgtcgctaatccattggctaaaccagtcataatgaggtaaataatcaataatcgatgtactttttgaacaaaaaaagaccgcttaacctgtttaatgttaggtggcttctttctagcgcgaccacaaacggtccaagcaacgcctgaagaaacgcaaactgccattaagacagcacaagatcatctatccgaattgaataataatattagtaatttaacgttaaaaacaacgcaattgaacgaacaaatgattgcaaaacaggcggatattaaagaaaaacaagacgagctaagcaaaacatctgctgattatcaaaagcaagtggcgattattgaaggcaacctgcggcaattacaaacacgagatagcagttttaatcttgatatgatcgatagtttattgtcgagccaaagtttgagcgatttattccaaaaaggttcaatcatcaatcgactgttagacgctaaggcggataatgccgctgaaacggcctcattagctgaaaaaaagctgaacaaaagactgaattagaagcgcaacaggccaagttggtatcattgtcacaggaaaatgatgctgcaattaaggacttagatcaacaaaaacaacaagctaacgaccaattaacgcaactacaaacgaagttcaagaaagaattagaggcgcaagcggctgctcaaaaagcggcgagtgatgcaggtgccgcattaattactggtaacaaggatttaatgaataataagattatccaagaagcggttaaatatttaggcgtaccctatgttttggggggcaccacacccgaaggatttgactgttctggcttagtgcaatacgtttacgctaaaaatgggattaaattaccccgtgtttcacaagatcaaagtaagttaggcaaagatgtaccgctcaatgaattacaaccaaacgacctattattctggggaggggttggaacagcccaccatgtcgcaatctacattggtgatggctactttatccaagcaccacaacctggcgataaagttcgaattactaaaatttcagattacaaaccagattttgcccgtcgtttatcataaaaaaataagaactgatcaaggaattgaggcgtttcgattaccttgggcagttcttttttaaattgtggtagtaattcatgcgtaactatagtagaatacgatttgtttgaataaacggcaattatttttttaagttatagagaaattcaaaagtcactgtgtggattgcgacgaatgatattcacatgagggctttttatgttagaaatattatttaaaggggtcatattgctatgcaacagttaaaacggatttttatcgggaaaccgttaaaatcttccgatgagggtaatcaaaaattaggacgctttaaagcgttagcgatgctatcttctgatgcattgtcatcagtggcctacgggacagaagaaatcgtcatcgtattaacgaccctttcggccgcggcaatttggtattcaattccaatcgcagcctttgtgctcgtattgctattgtcattaactttgtcatatcgccaagtgatccacgcctatccaggtggtggtggcgcctacgttgtttccagtgaaaatttggggaaaaatgctggtttagtggcaggtggttcactgcttgtggattacatgttaaccgttgcggttagtatttccgcgggtgcggaagcgatcacctcggccattccggcattgtatgggcatcaagtagggatttccttctttatcgttttgatcttgatgggaatgaatctacgtgggatgcgtgaatcagcatcatttttaatggtgcccgtttacttgttcgtcttgatgatgactttaatgatcatcgttgggtgttataagatcttcacaggtgcgattccgttccacgcaacatcaaccgttggggctgttgtaccaggtgtttcgatggcgttgatttttagagccttctcatcaggttcatcatcattaaccggggttgaagccatcagtaatgccgtcccatttttcaagaagccacgtgcaacaaacgcggctgaaactttagcaatcatggcagccatcttaggtttcttctttgctgggattacatttttaaactactggtacggcattgtaccagcagaaaaagtaactgttttatcacaagtggcccaacatacctttgggaaaggctttttattctatattgtgcagttcgcaacagcctttattttagccgtcgctgcgaataccgggttctccgctttcccagtgttagcgtataatttagccaaagacaaatatatgccacacatgtacatggatcgtggcgatcgtttaggttattcaaacgggattattacattggcgattggttcaatggcattgattttcatctttaacggggatacatcacgcttgattccactttatgcggttggtgtgttcattccatttacgctttctcaatctgggatgttgcgtaaatggtgggtcgaacgaccaaagaattggttcggtaaatcaattgccaattttgttggcgctttgatttcgtttgccatcttagtcattctcttcgtttatcgcttacctgatatctggccattcttcatcatcatgcctgttatgatttggattttctataagattcatgatcattacaagaaagtggcgcttcaactacgcgtgagtgctaaagaagccatcttgcatgattatgacggttcaactgttattgtcttggtcagcaacgtgacccaagtaacccgtggtgcgctagattacgcacaatcaatcggggattacgtgattgcgatgcatgtctcaacggatgaaaatccagctaaggaacgtgaaattcaagctgaattcaaggaagattttccgaatgtccggttcgtcgatgtccattcatcataccggtcaattcaaaaaccaattgttcgctttgttgacattgttagcaagaatgcgcaaaaacggaactttacaaccacggtcttggtcccacaattcgtaccaagaaaaccatggcaaaacattttgcataaccaatcaagtctaagactaagaacggcatttgcaaaccgcgaaaacattattatttcaacatatagttatcacttaaaacactagaagtgcgactcgatctgagtaggctttgaggattaacagtaaaatgggcattgtggcggttcttgccatgatgctcattttgcagttaaccggaaaagactgatcgaggagcgcgttaaagaaagaagtgcgtttagcaaccgagcattaatacaaaattggcagttatcccgagttgtgggatgactgccaattttagattaagcggaagttggtgcaactaaaagcacgttagaagagaagtgtgtttgaaacggtttgactttgagcattagcctaaatctgtgaatgagcgacggagttgatcgtttgcggattgtagctaagcgcaagagtcagtttcaaaaagcacgttaaaagaagaagtgtgttcaaaccgattatgttctgaggattagcaaaattagacgaataagcgacgaagtcgattggttggctaattttgctaaacgcaggaacatggtttgaaaagcacattatcagccccgctcaccttttcggtgcgcggggctttttttgtttttctacgggtacagcaaaactttttattctgggcaaaaattgctacaatagaagctatatcaaagtctgagaaagaacattaaggggcgcaacatgcgaattttatttattggtgatacagtgggcacaatgggtcaaaaaatgatcaatgattacctaccagcattaaagcaacaatacaaaccacaggtgaccattatcaacggcgaaaacatcgcggatggtaaggggatgactcaaaaggattataagaatcttttacaagctggggccgatgcgattacgatgggcaatcatacttggaataagcgcgatattttagaattcatcgacgatgctaaaaaattagtgcggccggccaattttcccaaaggaacgcctgggcaagggatgacgatgattaacgtcaatcaagccaaattagccgtgattaacttacaagggcgcgccttgatgaatgaactactaattgatccgtttgaaatgttagatgaaatagtggctgaaattagtaaagaaaccaactgtatcttcgttgattttcatgccgaaacgacgagtgaaaaactcgcacttgcttggtatcttgatggccggatttcagcgttagttgggacccatacgcatgtgcaaacaaacgatgcgcgcgtcttacctgaaggcacagccgttttaacggatgctgggatgactggcccttataacgggattctaggcgtgaagcgcgaaaagatcattaatcggtttaaaacacaacggccagaacggttcgaattagtgaccgaaggaccgggtcaattgaatggctgtttaattgaaattgatgacaaaacaggtcacgctaaatcaattaaaccaatccagatttcaccagatcacccctatacgcaattttaagcaccctagcagcagatcaacgtcaatgagagagggattaacaacatgccacaaaaaacgaaagaaacgccaatgatggcgcaatatcaaaaggtcaaggatcagtatccggacgcttttttattttatcgcctcggtgatttttacgaactctttaatgatgatgctgtcaaagcttcacaattattggaactcacactaacagcacgcaataaaaatgcggatgatccaattccaatgtgtggggtaccgcaccacgcagcccaaaattacatcgatattctagtcgatcaaggttacaaggttgccatttgtgaacaaatggaagatcctaaaaccgctaaagggatggtcaaacgggaagtcattcaactagtcacaccaggaacgatgatggatgaaaaagccggccatgccaaacaaaataattacttaacggcagtggtggctgatggcgatcagtttggatttgcttataccgatttatcaactggtgagatgaaagtcagccagattgcgagtttggatttattgctcaacgaaatgttgagtttacaaaccaaagaagttgtcattaaccacgatgttgccagtgaggttgtgcacgcgtttgctcaacaacaaattctcgtgtcgtatcaagaagatggcgatgcaacggccgaagtcagcttcgtttcacaaaacatctcccagccccttgaattggccgtgattaaacaattggtcttgtatttggcaacgacgcaaaaacgccatttagggcatttacaacgcgcccaagagtacgagccatcccaatatttaaaattagatcattctgcgaagatgaaccttgaattaacggcttctttacgcactggtcataagagcgggacattattgtggttattggatgaaactaagacggcaatgggtggccggttattaaaacaatggttagaacggccattattggatttaaaggcgattcaaaaccggcaacgccaagtcgctagtttcatgaaccattattttgaacggacaaacttgcaagacgccctcacaaaagtgtatgacctagaacggctagcaggacgggtcgcatttggcagcattaatggccgtgatttaattcagttgaagacttccttggaacaaattccaacgattaaaacgattttaacgggcattaatgacgatcagacctttgaccgtgcgttagaccaactcgatccggttgatgatgtacgcgagctcattgaaacggccatcaatcccgatgcgccaatttcagtgactgacggtgggattattcaatcgggttacaacgaaacattagatgattatcgcgatgcgatgtctaacgggaaacaatggctggcacaactggaagctaaagaacgcgaaattaccgggattcataatttaaaaatcggctttaaccgcgtgtttggttactatatcgaagtgacacgtgcgaatttagacgcgctacctgaagggcgttatgaacgtaaacaaaccttaaccaacgccgaacggttcattacaccggaattaaaggcgaaagaacaattgattttagaagccgaagaacattcaaccgcgcttgaatacgagttattcacgcaagttcgcgaaaccgttaagttggagattgaacggcttcaaaccctcgctaaaagtttggcggcccttgatgtcttacaaagttttgccgtagtcagtgaaaactaccactacgttcagccgacattaatggctgatagtcgcgaaattgatttagtggatgggcgtcatccagtggttgaaaaagtgctcggtcgccaaaaatacattcccaacgcggttcaaatgggcaccgatacggatatgctcttaattactggtccgaatatgtctgggaagagtacgtacatgcggcaactggctttgacggtcatcatggcgcagatgggatgttttgtaccggctaaatctgcgaacttaccgatttttgatcagatctttacgcgtattggtgcggccgatgatttaatttccggtcaaagtaccttcatggtcgaaatgatggaagccaatcgcgcgattatgaacgcgacacaaaatagcttgattctctttgacgaaatcggacgcggaacagccacctatgatgggatggccctggctcaagcgattattgaatacattcacgacaacgtgcatgctaagacactcttttcaacgcattatcacgaattgaccagcttggctgattcactcaccgcattgaaaaacgtccacgtcggggccgttgaagaaaatggcgagttagtctttttacacaagatgctggctggcccagctgataagtcctacgggattcacgtggctaaattagcggggatgccaacgccattattgaaccgggcggatgttatcttggatcaattagaagacaaaccaaaggcagcagtcacgccggctgctgaaccagttgaagaagtggatgaacaaatctcattgttcgaaccagaagtggcaccacaagcggatccaaaagcagctaaagtcctagcggcggtcaaacagttcgacctaatgagcgccacaccactagacgcgctaaacatgctatacaaatggcaaaaggaattaaaataagagtgcgtcaaaagcggggatactgcgaggattagctacacgtcagaaaaaggagaacgctaatggggaaaattcatgaactgtcagaaatattaagtaaccaaattgcggcgggcgaagtaattgagcggccagcttcagttgtcaaagagttggcagaaaatgcgattgacgccaatagtactcaaattgacattgtgattgaacaagccggcctgcaattgattcaagtcatcgataacggcgatgggattgaaccggaagatgtacccaccgcatttaagcgacacgcgacaagtaagattgccacgcgccaggatcttttcaaaattcagtcacttggctttcggggtgaagcgttagccagtatcgcgtcagtgtctgatttgacgattgaaacggcgaccgctgattcattagggacattcgcccatttcaaaggtggtgtcttagaagaacagaaaaccaatccaattcgccctgggacagcaatcacggttcgcgatttatttttcaacacgccagcccgcttgaaatatgtgaagacgttccagactgaattggcaaacgtgatcgatatcgtcaatcgattggcgatgagtcatcctcagattgcgtttacgttaaccaatgatgatcacctgctgttaaaaacggcgggcaataacgatttacaacagacgattgccggcatctatggcgtcacgatggctaagcaactcttgccagtcagtgcagaagatctcgattttaaattaaccggctatgtatcgctaccgaaactaacgcgggccagtcgtaattacatttcagtgttgattaatggtcgttatatcaagaattatcaattgaataaggcgattatcaagggttacggttcaaaattaatggttggccgttatccagtcgtcgttttaaatattcaaatggatccactgttaatcgatgtcaatgtccatccgaccaagcaagaagtccgcttgagtaaggaacctgctttgatggcgttgattgaaaaagcaattcgtgagcgactcagcaccgagaatttaattcccgatgcagtgcagaatctaaaacaaacgaaaccggtcgatgtggaccagcttcaaatggatttaaaccaaattacgagtcaacggcgcaatgcgactggtacggtgcggccaattcagccccaaacagttcctgaaaagccggttaaaactgaaatgcaagcggcagcgcaaattgcggaaaccgaaacaccccttaaacgagaaccaactgctaatcctaatttaaatagcctgccgatatttgaacaaccccaacaattggcccggtgggatgataagtacgaagcagaggcgatcggaaatccgtttggtgaacaacctgaagatgatgcagcacccattgagcgtttcccagcgttacgctatattggacaactgcacaatacattcttattagcagaaggtgaagatggcttttacatcttagatcaacatgctgctcaagaacggattaagtatgaatactatcgcgaaaaaattggtgaagttagcaacgacgcccagaatttattggtgccccttgtgttggaatatcccaatagtgatgcgattaagattcaagcacaaaaggaactccttgccgcagtgggtgtgcagctagagagcttcggccaaaatagttttgttatccatagtcatccgacgtggattgcgcaaggccaagaagaagcaacgattcgcgagatgattgacactgtattggaaaacgggaagttagacattgcccatttccgtgaaaaaacggcgattatgatcagctgtaaacagtcaatcaaggcacaccatcacttagatgatgcgcaagctaaagcattgttggttgatctggcacagacggaaaatccgtttaactgtccacatggccgaccggttttaatccattacacgcaaaaagatttagaaaaaatgtttaaacggattcaagatccacaccatagttgggagggtgaataatgtttatcttagcatcacaatcaccaagacgccgcgaacttttacaaaaagtcgtgcctgatttcgaagtccaacccgcaacaatcgatgaacgccaggtaccagtgacggcaccagctgactacgtgcagatgttggcgcaactgaagggtgaatccatcgcccaaaagaatcctcaggccactgtgctcagtgctgatactgttgtcagttttcagggcacgatttacggtaagccacatgatcgtcaagatgcagccgaaatgttacggcaattgagtggcagcacgcatcaagcttatacaggtgtttggttatccattgatggtgaaatccgcaaaacggttgtccaaactgatgtcacgttctggccgttaagtcatgaaatgattgaaacgtatttagacaccgaagagtaccgggataaggctggtgcttatggtattcagggacagggaagtctgctcgttgagaaaatcaacggtgacttttacaatgttgttggcttgcccatcagtacggtggctcggttgttaaccgctaaggaggctgactaatggcaacgcaaaacattgccgtttattgcggcgctagtagtggtaataaaataatctacacggaagcggctaaggcgttaggcacttggattgctgggcgcaatgcgcgcttgatttatggcggcgcccaagttggtttaatgggcaccgtggccgacacggtgttagcccatgatggacaagtgaccggcgtcatgccagggtttatgagtcagcaagaactcgtccatccaggtttaaccgaaatgattaaggttgatacgatgtcagcgcgtaaagccaagatgattgaactggcagatgtgtttatcgcattgccgggtggtcccggtacgctggaagaaatgagtgaagttatttcatgggcgcgaattgggcaacaaaatggtccctgcattttttataatgtcgcaggctattatgatttgttacaacaatttttagcccacatggtcagtgaaggttttttaacacaggtcgattttgaaaaatacttatttaccgattcgttcagtgtgatggcatcctttatcaaggattaccaaccgccgaagattcgtgaatactaattgctagggtttgagttggccgtgggtcacacttaggcccttcttttacgctttttggctgctggctgtttcacgattcggattttatgttacaatttaacaagcaaatatacgttctcgtaaagtaggtaaatttatgtatgaatatttaaaaggtttggtgacggcggttagtccgtactatgtcgtcttagaagttcaaggcgtcggctatcaattgcaagttgctaatccgtatcgttacaccgaatcaacgaccgatatcgttcagatttatgtctatcaagcggttcgtgatacggatatcacgttatttggtttttacgatctagatgaaaagcaaattttccaaaaattaatcagtgtttctggaattggtcctaagagtgccttggccatcttagccaatagcgatcattctgggttaatccaagcgattatgaatgatgatgtgagctatttgaccaagttccctggggttggcaagaagactgcccaacaaattgtcttagatttaaagggcaagctcggcgatttggaacaaaccgaaacgctcgctggtcaaacggctatcgaacttggtacgcctggtgaatcaccagaattaaacgatgcgttagcggcattaaccgcgcttgggtattcagcccgcgaagtcaaagcgattaccaaaacactggctgatttcaatgcacaaactacggatcagtacttacgtgaaggtttacgcttattaatgaagaaataaaggaggactaatggatggcagaagaacgaattgtttccgcagaaaacgaagatttcgcagaaacaagtattgaaaagacgttacggccacaagtcctcgcgcaatatatcggtcaagaccgggtcaaaaatgagttggcggtttatattgaagccgctaaaaagcgggaagagtcgttggaccatgtgctattatatggcccgcctggtttaggtaagacgaccttggcgatggtgattgccaatgaactgcatgttcagattcggacgacgagtgggccagcaattgaacggcctggcgatttagtcgcgttgttgaacgagttacaacctggtgatgtgctatttatcgatgaaattcatcgcttgccgaaagtggtcgaagaactactttattcggcgatggaagatttctacatcgatatcgtggtcggacaagggccaactgcgcacccggtgcatttcccattgccaccgtttaccttgattggcgcaacgactcgggccggtttattgtcggcaccgttacgtgatcgtttcggaatcgtcgaacatatggcatactatgatgaagatgatttggtcgatatcgttgaacgctcggcagatgtctttaacatggccattgtccaagaaggcgcgcatgagattgcccgtcgttcgcgggggacgccgcggattgcgaaccgcttattgaaacggattcgcgattacgctcaagtcgcggaccaagcggcaattgatcaagcgattgccgaccatgcgcttagtcaactacaagtcgatgtacgtggcttagatagtattgaccgcaagattctccagatgatgattgactattatcatggcggcccagtcggtctaaagacgattgcggctaatattggtgaagaaaatgaaacaatcgaagccgtttacgaaccgtatttattacagattgggttcttaaaacggacaccgcggggacgtgttgtgacgcccgctggttatgaacatctcggcattccctattcagaaaattagaaagaggttacacaatggtttcaacagaagattttgattataatttaccagaagaattaattgctcaaacaccgatgattgaacgggcagcgtctcgtttattggtgatggatcacaaaacaggcgcactagaagataaagttttctacgacattatcgatgaattaaatcccggcgatgcagttgtcatgaacaatacacgggtcttgccagcacgtttatatggtgtgaaacctgatacgggcggccacgaagaagtcttgcttttaaataacacgcatgacgatgaatgggaagtcttgatgaagccagcacgccgggccaaagtcggcaccgaagtcgtttttggtgatggtcaattaaaagcagttgtgaccaaggaactcgaacacggtggtcgcatgattgaattcaagtatgacggcatcttcatgcaaattctagaagctttaggtgaaatgccattaccaccatacatcaaagaaaaattagatgatccagaaatgtatcaaacggtttatgctaaagaacctggttcagctgccgcaccaactgctggcttccactggacagaagaactcttgcaaaaagtgcaggataaaggcatcaaactcgtgtacttaacgttgcatgttggtttgggaactttccgacctgtttcagaagacaacgtggaagatcacaaaatgcacagcgaattctaccgattaacagaagaagctgctgcaacgttgaatgaagtcaaacaaaatggtggccgcattgtggcaacggggacaaccagcattcggacgctagaaacaattgcgacgaagtttgatggtgaactcaaagctgatagtggctggacatcaatctttatcaaacctggttatcaatggaaagctgttgatgcattcatcacgaacttccatttaccaaaatcaaccttagtgatgttggtcgcttcatttaccggtcgcgaaaacatcttaaatgcttatcaacacgctgttgatgaacggtatcgtttctttagcttcggcgatgccatgtttgttaaataattcgacaaaaatgaggtggcagcattgatgtatttgagaaaagcaacgtttacagatttaccgcggattttagagattatcgaacatgcaaaggccgccttaaagaatcgccagataaatcaatggcaagcaggtgaacctaatcaaactcagtttgaggacgagattcaccaagaattatgttacattctgatggctgaccaacaggtgattggggttgcctcaattctagcaactgaagatcctggctatgcagcaattaccaatggtcaatggcaatctggttcgacaccttatttttcaattcaccgcgtcgcactcgatagtgccttccacggccaacatctcgggacacagtttttaaccttattggtgaccgctgccagtttacgaggtgcacatgatttacgcatcgatacgcaccctgataacttggcgatgcaacatatgattcaaaaagtagactttcaatatcgtggggacatcttcattgaaaacgatccgtcaccgaaacgctatgcgtaccaattattactgaaccaacaataatcctagaattggagtcgattaaatggaaccagcgatcaagtatcgtttaatcaagaaagaaaaacataccggggcgcgccttggtgaaattgtgacaccacatggcacgtttaaaacacccatgtttatgcctgttgggacccaagccagtgttaagacaatggcgcctgaagaattaaaagaaatgggtgccggcattattttatcgaacacctatcatctctggttacgacctggggaagacatcgttgaaaaagccggtggtcttcataagttcatgaactgggatcgcggtgtgttaaccgattctggtggtttccaagtgttctcgcttgcgaaattacgggatatcagtgaagaaggggttgctttcaagagtcatttgagcggcgaaaaactgttcttatcaccggaaaaagcaatccaagtcgaaaatgctttgggtgccgatatcatgatgagtttcgatgaatgtccaccattctttgaaagttatgactacgttaaaaaatcagttgaacggacatcacgttgggctgaacggggcttgattgcgcatcaaaacccagcaacgcaaggtctatttgggattgtccaaggggccggctttgaagacttacgccgccaaagtgcgcgcgatttagttgggatggacttccccggttattcaatcggtggcttatcagttggtgaatcaaaaggcgaaatgaatcgcgtgcttgatttcacaacaccaatgttgcctgaagacaaaccacggtacttgatgggcgtcggttcgcctgatgccttgatcgatggtgtgattcgcggtgtcgatatgttcgattgcgtgttgccaacccggattgcccgtaatgggacaacgatgacctcacaaggccgattagtggttaagaatgcgaagtactcagaagatttccgcccactggatcctaagtgtgattgttatgtctgcaagaactacacccgcgcttacattcgccacttgattaaagcggacgaaacgtttgggattcatttgacgagttaccataacttatacttcttgattaatttgatgcatcaagtgcaagatgccatcgaacaagataatttattggaattcagagaagcgttcttcgaagaatatggttacaatgaaaagaacactcggaatttctagtgaatcactggaagttgcttgataagtctgatagagttagtaatagacaaaattgaaaagaggttttttaaatggcaaactttgtattaggtgccggcggttttaatcccagtttcttcgttatcttaattttaatgatggcaatgatgtatttcatggtgatgcgcccacaaaagaaacaacaacaaaaacaccaagaaatggtgaaccaaatgaaaaaaggcgacgcagtcatcacaatcggtggtttacacggtgtgattgattctgttaatacagatactaaaatcgttgtcttagattgtgacggcgtttacctcaagtttaacttgagcgcaatccggacagtaacaccaactgcttcagaagccgcaacagtggttgaagaagaaacggttgaagaaacaaaagaagatacaaaataattcagagagcgctcgattgaatacttcaaccgagcttttttttatttgcattatatagtgaatttattatcaaatataggcttttaaaaagataaatcgcctttaaataagaaataaaatttgtaattatagtcacaaaatagtttacaaacaactcaaaatgcgctaaactaactttgttaaataaatcacaatagttaattggcatggagggaatcgatatggttaagaaagcagcagttgaaacggttgaaaatacagtgaatgaaatggtcaccgatttagtgacgcgtgcacaacgggcattagcaattttggaaacattcgatcaagccaagattgataatattgtccatcaaatggcgattgctgggttagaccaacatatggcactcgctaagatggcggttgaagaaactggccgtgggatttatgaagataaagccatcaagaatatttttgcaactgaggaaatttggaatgcgattaaagacaataaaacagttggtgtgattgaagaagatccagaacatggcatcactaagattgcagaacccgttggtgtcattgctggtgtaacgccagtcacgaatccaacttcaacgacgatttttaaagctgagatcgcgattaaaacgcggaatccaatcatctttgctttccatcctagtgcgcaacgttgttcggctgaagcattgaatgtcattaaagctgcagcggttaaagccggtatgccagcagatgcactcttatatatcgaagaaccaagtattgcagctacccaatctttaatgaaccatgaaggggtcgcaactgttttagcaactggtggtcctgggatggtgaaagccgcttattcaactggtaagcccgcactgggggttggggctgggaatgcgccagcgtatatcgaagcttcggcgaatatcaaacaagccgtcaatgatttaatcctctcgaaatcatttgataacgggatgatttgtgcttctgaacaagccgtaattgttgatgctgaaatttatgcggcagtgaagaaggaattccaagcgcaaggggtttactttgctaaaccaagcgaattatcagcactcaatgacgcagtaatcgatccagataagaatgcggtccggccttcaattccaggccaatctgctgctaaaattgccaaactagctgggatcgatattccagaagatacgccagttttaattgctgaaattaaaggtgttggacaccaatatccactctcacatgaaaaattatcacccgtacttgcgatgattaaagctaaagatcgcgaagatggtttgcaactctgtgaagcaatgctagatcttggtggtcttgggcatacggcttcgttgcatacaacggatgaagctttaccactcgaatttgcaaaacggatgaaagcatgccgggtcttagtgaatacaccatcagcacaaggtgggattggtgatttatacaatgacatgttgccatcattaaccttaggctgtgggtcatacggccataactcaatctcccacaacgtttcaacgatcgatttgttgaacgtgaagacgctaaccaagcgccggaataacatgcaatgggtgaagttgcccagcaaaatctattttgaaaaaaattcagtgaactatttagaaaaaatggcggacttgcataaggtttttatcgtcgctgatcaagggatggtcgacttaggttacgtgcaaattgttgaagacgtcttggcgcgccgcactgatcaagtgcaggtccaaatctttgccgatgtcgaaccagatccatcaaccgataccatttataaaggcgccgaagtgatgaaacgcttcaaacccgatacaattgttgccattggtgggggatcagtcatggatgcggccaaagggatgtggttattctatgattcagaagatgccgacttctttggcgctaagcaaaaattcttagatattcggaaacggacttacaagttcccaaacctcgatcgaacgaaaataatctgtatcccaaccacttctggaacgggttctgaagtaacgccgtttgcggtcattactgatagtgaaacgcatatcaaatatccattggcagattatgcgttaacaccagatgtggcaattgtggatagtcaattcatcgaaagtgtgccaccacgcgtggttgcgcatactgggatggacgttttatgccacgcgactgaaagttacgtatcagcgatggcgtcaaattatacaaaagggctcagtttgcaagccattaaattagtctttgataacttacaagcgagttatgcgggtgataagacagctaaagccaatatgcatgatgcgtcaacaatggcgggaatggcgtttgccaatgcgctattaggtatcaaccattcactggcgcacaaactgggcggcgcgttcaatttgccacacggattgatgattgccattacaatgccgcatgtcattcgctataatgctaagacaccaacgaaacgggcactctgggctaaatacagttacttcagagcagatgaagattatgctgaaattgcacgttatctcggtttaccaggtaaaacgactgaagaactggtggccgcttacgcagatgctgtgactgcattggcggaaagtatcggcatcaagatgcgtttacgtgataatggcgtgacaaaggccgactttgatcgccacgttgatgatttagcagaactggcatatgaagataactgtacggtaaccaatccaaaagaaccattgattaaagaattgaaagggattcttgaagcagaattctagcaaattgaccaagcgatttgttagaattagtggtttgaggagaccgaccataaatttaaggcggtagactgaaacaaatcggtctaccgcctttttttgttactgaaaagagattaattttttactatttaaggggctaaattgaagcttgatggtatgaaaattattacaaataaggcataatagagagtagacattcatttagttcagggataactaagaaaagtttgtcgacaaacttgattaaggatcgggatggcaatgacacccaataaagaagactatttaaaaattatttttgaacttggtggcgacgcaaagaaagttaccaataaggaaatactagcgggattgaacgtttcggcggcatcagtcacggaaatggtcaataagttagtgaaggaaaactacgtcaaccacacaccttaccaagggattcaactaacaggtgaaggcgcccgcgaagcagccctattagtgcgcaatcatcggttatgggaagtttttttagtcgacaagttacattatcaattcaatacggtgcacccagaagcagaacaactcgaacatgttactaatcacgacttggctgaacggttagctgatttcttggggcatccaacgcgttgcccgcatggtgggattattcccaatgccaagggggaattcgaacaacaaagtcacatcgcacttgaaacattacaagtgggtgaaacggcgattatcgatcgcgtattggatgataatgacttattaaaatatacactggaaattggcttgtcagtcggtgacagtgtgacgctccaaaaggttggcctcttcgaaagtccgttgactgtttttaataatacgagtcaaacagaaatcaaaatcggcctcaaagcggcacaacacatctttgtgacgccacaaaattaatttatatgaaagtggtgtgagatatgcacacagatttagcagcactctttattatttttggtggttccggggacttagcccaacggaaattataccccgcattatttaatttataccggaagggttatttaaaagaacacttcgctgtcattggaacagcacggcgaccatggacggatgatcattatcacgaaatcgtcatgacagctttggacaactttgatgaagatcaagcaactaaagaagctttcgtaggccatttctattatcaatcacatgatgtgacggatgctaagcactacgaaacattaaaggctttagcaagtcagttggatgaacaatacgacttacacaaaaatcggatttattacatggcaatgtcaccacggttcttcgggacaatcgcaagtcatctcggatcagaagcgctcctaacggcggatggctttaaccggttgattatcgaaaaaccatttggtcgcgattatgaaagtgctaaggcgcttaaccaagaattgacgcaaacctttgatgaagaccaaatctaccggattgatcactaccttggtaaagagatgattcaaaatatcgttgctttgcgttttgggaacggtctattgagtggtgtatggaataatcaattcattgataacgtccaaattacgttggctgaatcagtaggggttgaagaacgcgctggctattacgaaacatcgggggccttgcgcgatatgttccaaaaccatatcatgcaagtgatcggaatgcttgcaatggaagtgccggttaactttacggcagaagatgtgcaacgtgaaaaaacacgtcttttcagaagtattcaaccttattcaccagcagaaatcaaacaaaactttgtgcgcgcccaatatgctgaaacatcggtggatggcgaaaacaaaccggggtatcaacaagaaaccaacgttgcacctgattcacaaaccgaaacatttgtcgctgggaaagtgatgattgataacgaacggtggtgtggcgtaccattttacgttcggaccggtaaacgattggcacgtaaagaaacgcaaatcaatatcgtcttcaagaagactggcgtcaatatttttgctgatgataagtcggatcgttcagcaatggcaccagacgtcttaacgatttatgtcgaaccggaacaaggcttttcattaacgattaatggtaaagaagtcggtcaaggattcgccttgaaacctgatcaactggcttaccaatatgatgaacagatgttggctgacagtccagaagcttatgaacgtttgattttagaagcgctcaatggggatggcacgaacttcacgcactggcatgaattagccgcttcatggcaatttgtcgatgcgattcgtgaagtctgggatgcggatcaaacgccgctaccaggttacccaatcggttcaatggggcctaaagaagcaacagatttactggcaacaacaggggccgaatggatttttgatccaacccaaaataattaaattaaacaagtcagcaaagtctgtgtatgagatgctcatgccaggcttttcttattgaaagaagtgcgtcaaaagcggaacaatgtgcctgaaaaagcatgttgaaaaaattaaggaggggtaacatggcggagttgttcaagattccattagaaaatgacacgagtcgcaaaatcattcacattgatatggacgcgttttacgcatcgattgaagagcgtgaacagcccgacttacgccaaaagcccctcgtgattgcccgtaatccgagtgatactggtggcaaaggggtcgtgacgaccgcgaactatgttgcccgacaatacggtgtgcactcggcgatgagtgcgcaaaaagcagctgaactgattccgaatcaccaagccgtttttaaggcgcccaattttccgctttatcaatcggtctcggaacagattcacacgatttttcatacggtaactgataagattgaaccgattgcttttgatgaagcgtaccttgatgtcacggaaaataaactcggcttggcacacacaattgatgtggtcgcctacattcaaaaagaaatccttaaagaaacccaactcgtcagctcggcagggatttcgtacaataaatttttagcaaagatggcatcggattaccgcaagccagcggggcggacactcgttttaccggaacaagcgattgcctttttaagtcgcttgccaattgaaaaattccgtggggtcggtaagaaaacggcgccgcgaatgcaagaactcgggattttaacgggggcggacttgcttgaacaatcagaaatgatgctgatgcaaaatttcggcaagcttggctatggcttatatcggcacgtgcgcggcatcgataatcgcccggtcgcctaccaacgtaaacgcaaatcaattggcaatgagaatacttacgggcaacccctaatcagtgaagagcaggtgcaagttgagttgaagaagttagcgattgaacttgaacggcgtttacgcaagaatcaaaaacacggtttgacagttgttttaaaagtgcggaatcgccaatttgaaactattactaagcgtaaaacatttaacgaatatgtcggcaaggcagctgaactcgaggcaatcgcttgggaaatttggcaaaccatcggccatgcagaagatggcgtgcgcttgctcgggattacggtgactaacttggcaccgcaaacatttgaaaacatcacgttaccgttatacgattgggagcgtgaatagttgagtttcctttgtttttgtgcgctaaaaccgatatactgttaataactatgtaaatccgataaagggtggtggcgttgagtggcaactaagcatgatcaaattttaatgtacatcgaaaatttaccgattggtgacaagatttcggtgcgctcaattgccaaaacactctcggtaagtgaaggaacggcttatcgcgcaattaaagcggcagaaaataacggcctggtcagcacaattgaacgggtcggtaccatccgcattgaacaaaaattaaagggtaagattgaaaatctgacctttgaagaaatcgttcaagtgattgacggcgaggtccttggtggccgcgctggtttagacaagttgttggacaaatttgtgattggcgcgatgcaaatcgatgccatcacacgctacattacgccgaagtcattgatgattgttggtgatcggaaggatgtgcaacgtttagcacttgaaaacggggccgctgttttgattaccggtggttttggcacttcggcggacgtcattgcattggccaacgacttggctttaccgattttgcaaactgcctacgatacctattcggtggcggcattgattaatcgggcgttgaccgatcaattgattaaaaaagaaatcacaacggtggctgatatctaccacccacttgctgaaatccacacgttacatgctaatcaaacggtggccgactacaagcaattgagtgcggcggtaaaacaatcgcgttttccagtcgtcaacgaacatatgcgcctcgttgggattgtgacggtgaaggatattttagataaaccggccacgatgaccttggataaagtcatgaccaaggaacccgcgagcgttaaaaaatacatgagtgttgccagtgtcggccattcaatgacttggaatggtttagaagtgatgccagtggtggcggacaatttagaactagaagggttaattacccggcaagatgtcatgagcaacatgcaaacggcgcaacgccaaccgcaagtcgccgagacgttttatgatcagattgtcgaaccactgcgccctagtgaaactgtcccagacttttatacggcggcatatgaatatgaagtgacgccccagatgacgaataacttagggacaatttcgtttggtgtactgaccgaagcggtttcggcagcttgtcaacaaatgctccagacgcaacatcagcgctattcaatgattgaacagatcaacctccattatttacggttgattcaaatcgacacgcagattcagattttaccacgcttgctcgaaattggacggcgttcagctaaaatcgatgtcgatgtttacgccaatcatgtgattgtggctaaggccctcgtcactggtcaactcttagaaagaggttaataaatgacaactccagaacaaattattgctaaaattgaaacttacgatacgattatcatccatcgtcatgtcaatcctgatcctgatgcgattggctcacaagttggcttagctgaagtactgcgtaacagctacccagacaagacgatttaccaagtcgggagcgacaccggtaacttggcatggctcgcaaacgttcaagaaattgaaccggctgcttatcaaggtgcattagtgattgtgactgatacagccaactcacctcggattagtggtgagacgtttaacttaggcgctgaattaatcaaaattgatcatcatcccaacgatgatccttatggggatttaaactgggtgttacctgatgcctcaagtacctcagaaatcattattgacatcgtcaataacagcgaaggccacttacaattcaatcaagcagctgcgcgtgttttatatgccgggattgttggtgatacggggcgcttcatgtttaattcaaccagtccacataccatggaatgtgccgcccaaatgatgacgtttgatattcaccatgataagctcaatcaaaagatgaacgaaatcacgttggaacaagccaaattacaagggtacttattcgatcaacttcaagtgaacgaccaacaagtcgcctacttagtggttgatcgcgcaacccaggaccggttacatgttgaaccgcaacaagtacactcgattgttggaacacccggtcgtttgaaaggggtattaacgtgggtcatcttcgtgcaacaagcagatgacacttaccgcgtgcatttccgctcaaagggcccaatcattaatgaactagcgaagcaacatgatggcggtggtcatccactcgctagtggcgctaaggcagctgatcaagctgaaatcgacataattattgcagaattatcagcgctagccgcgcagtacactgaatagacgcagatccagatttaccggattcaaacaatagaaagcaggactttatggataatcaatttacacaatttaatctaaaacccgaaatcattgcggctttagacgacatgcactttacaaaacccacggcggttcaacggcgtgtgattccagccatcaacgctggtaaaagtgttatcggtcaatcacaaacggggagtgggaaaacccacgcgttcttattaccccttttaaataaactggtgcctgaaaaagacgaagttcaaatcgtcatcacagccccaagtcgcgaattggcttaccaaatctatacggctgccgaattaatcactcaacacatgacgggggatattcggattggtcgttatgttggtgggactgacaagcaacgccaaatcgaaaaactcgaacaacatcaaccacagattgtgattgggactcctggtcgaattttagatttaatcaagagcaaggcgcttaagatttatacagcgaagatcttggtcatcgatgaagcggatatgacacttgacatgggctttttgaggccagttgatgacatcgctagtcgtttgccagaagacttacaaatgatggtcttctcagcaaccattcctgataagttacaacccttcttacaaaaatacatgcacaatcctgtgattgaagaagttaaaaacgaaactgtgattagcccaacaatcgacaactggttagtgccaacgaaggggaaagccctcaaccaaaccatttattcattattgacgatgggccatcctttcatggtcttggttttcgctaatacgaagagcaaggttgatgacatccaccgttatttacaatcacaaggcttgaaagtcgctaaaattcatggcgatattccaccacgccaacgtaaacggattatgaaagaaattcataacttagactatcaatatgttgtggcaactgatttagcggcccgcggtattgatatcgaagggattagcatggtcattaatgctgaagtcccacgtgaagatttagaattcttcattcaccgggttggtcggactggtcggaatggtcttaaaggaaccgcgattacgctttatggtccagatgatgaacaagccgttgcacaaattgaagcaatgggcatcaagttcacaccaaagacatttaaagatggcgaattggtcacatcatatgatcggaaccgtcgtaaaaaacgggtagctaccacgcatgaattagatgtcggcatgaaagggatggtcaaaaaggccaaacttaaacgcaaacccggttataagaaaaagattaaagcagccattaaacaagatgcacaaaagaaacgccggattgaacaacgacttgaattacgtgaaaagaaacgtcaaaacaagaagcaaaatagctagttaattcataatcgaggtggctgtgatgcatgaaaatgacttacaattactgaactggttatcgttatccgaagaagcacggcgcgctaattttggccaggtgttgcgctactttgttagcccgctgattccaattgaagcgattcagagtgagaccgcaacgattggcactcaagtatttcaaacttacagtgcccggctagctgggcagcagtttatttttatccccggccaagctaatgtgcagttgggatggcaagcaggggcagcccacttagcaccgagtgagtggtttgcacaaactaaacgtacgttaccagttgatcaaggactcgtttgggcgacgcaagcggatgtcgatcaatacgttgatcagatgacatcagaatatcggattgttaatatggcaccgatgttagtggcacaaacaccaatttcaagtgagtgggtactccaaggcgagtatgaaacgacaacaggacgttttaatggaaaccaactagttgggcgtcagtttttggcggaaatccaaaataccttgtttcgggcgcggcgggaacaaaattcagctgaaacacttgaaagtgcgcacctaattttacaagcgggtgggcgaccagattgttaccaagtgtttgaaaaaactaatggtgacgaaagtgaactacgccagacattgcggcggcgcggttttgatctggtgagtgttgatcagtatgaatggcttaaaggtgcagggagtaagacgttgtggttaagtggtaatcacttaccacgaccgactcagcgccagcagatgccatttgggttacaagcaacagccgctgacggttatgaacttactcaagatccacttgtttataagggtggtgcttgtgtgacagggggacggtatagtttggaacaatggttgcctgaagcacccgcctatgaatctgggattcaaacggcggcattgggcaatccgacgcttcagtgctactatcggcctgcgattaccgttaccttggattagttgacaattcagcaaatcttttttatactttggaagtgttgggatatacgcaacgaactgacggagacaggaacgcctttctagactgagagaaggtgccgccattggttgacgtgctccccaacatcacaaacaattcaataaactcataaagaggttaacgactaacatcgttgcaatcaaggtggtaccgcgcttttgcgtccttgaaattgcagcggtgttttatttttttgaaggagcaaacatgatgaaaaaactaaccagtgcgcaagtgcgccaaatgttcttagatttctttaaagaaaagggtcatgatgtcgaaccaagtgcatcgcttgtcccagatgatgatccgacattattatggattaactcaggggttgcgaccctaaagaagtatttcgatggtcgtgttgtacctaataatccacggattaccaatgcacaaaagagtattcggaccaacgatattgaaaatgttgggaagactgctcgtcaccatactttcttcgaaatgctcggcaacttttctgtcggggactatttcaaagaagatgcgattccatgggcttgggaattcttaaccagcgacaagtggattggtttcgattctgaaaaattatacgtgacggtttatcctaaagatcaagatgcgcaccggatttggcatgaaaaagtcggtttgccagaatcacacatcattgaagttgaagataatttctgggatatcggtgaaggcccctgtggccccgattcagaaattttctacgatcgtggtcaaagcttcaacaacgttagcgaagatgatcctgaaaactatcctggtggcgaaaacgaacgttatctggaagtttggaacatcgtgttctcagaattcaaccatttaccaaacggcgaatatgttgaacaaccccacaagaacattgatacggggatgggcctcgaacgacttgtttcagtgattcaagaagccccaaccaactttgaaacagatttattcatgccattgatcgaagcgacagctaagatgagtgaccacaaacaatacggtcaaaatgcagctgatgatatttcattcaagattatcgcagatcatgcgcgggctgtgacgtttgcaattggtgacggtgcaatgccagccaatgaaggtcgcggctatgtactccgccgtttaattcgtcgggccatcttaaatggtaagaaactcggcatcaacgacgctttcatgtacaagttagtaccaatcgttggtgaaatcatgcaaagctattacccagacgtattagcacaaaaagaattcatcgaaaaagtcatccgttctgaagaagatcgtttccgtgaaaccttgaatgatggtttacgtttattgaaccaaacgattgacagtgtcaaagctgctggtcaaagtgaaattgctggggcagatgctttcaagttatttgatacgtatggtttcccaatcgaattgacaactgaatatgccgaagatgaaggcttaacggttgatcaagctggtttcgaaagtgaaatggcacaacaaaaatcacgtgcacgtaatgcccgtagtgatgaacaatcaatggggatgcaaaacgaacttttaatggatatcaaagtggaaagtaccttcactggttatacaacgcttgaaacagaaagtaagttgagcgtcatcttacaagataatgccgaacaacaaacgattaagagtggtacggcgcaattaatcttcgaccaaacaccattctatgctgaaatggggggccaagttgctgatcaagggatcattaagaacctagctgggcaagtagtcgctaaagtgactgacgtgcaatacgcaccaaacgggcaaccattacacaccgttgaagtgctcgaagaaatgattagtggtgtccactatgtcttatcagttgatccaaccttccgcggtggcgtcattaagaatcacaccgcaacgcatttattggatcaagccttgcgtgatgttttaggcgaacatacgcatcaagctggttcattggttgaacctgactacttacggtttgattttacgaacctcggtcaagtcacaccagatcaattagccactgtggaaaaaattgtgaacgaaaaaatttgggctgcactacctgtgaatactgttgaaaccgatattgaaacagctaaacaaatgggggccatcgcactctttaccgaaaaatatggtaagacagtccgagtggttcaaatcggtgattactcaatggaactttgtggtgggacgcatgctgctaacactgctgatcttggtctattcaagattacgagcgaatctgggattggtgccgggacgcgccggattgaagccgtgacttcaaaggcagccttcaagtatttgaatgacaaacaagccttattaaatgaattagctggtgaattgaaagttgctcaaaccaaggatttacctaagaagattcaacaattacaatctgacttaaaagcagaacaaaaagaaaacgaacaactcaaagcaaaatttgcccaacaacaagctggcaatgtttttgaaaatgtcgaaacagttggtcaatggcgcttagtggctgctgatgcaaaagttgccggaatgaacgaattacgacaattagcggatcaatggcaacaaaaacaaatttcagatgtcttagtgctcgcaacagttgcgggagataaggttagcttgattgtcgcggtcgcacctgatgcgattaaagcggggattaaagccggtgatttgattaaacaaatcgcaccactcgttggtggtggcggtggtggccgtccagacatggcccaagctggtgggaagaatccagctgggatcgcagatgctttggcagctgctaaaacagctttagcgaacgcttaacttataacgggattgtcgtcaattttttattgattgcaatcccgttatttttttgttctttttgttaatcaatttagcgaaatgtgttatagttatctctcatctgcattctgctaagagaggggagagttgtactttgtcctgttttcgagtagaatatggttgtataagtagcgaaaagttgaggtgttgagagatgaatctagataaaacagtccattttgattttggtaaaaatagccccaagaatgttcatgaaacattaacgacggtctatcagacattagaagagaagggctacaacccaattaatcagattgtaggttatctgttgtccggtgatccagcatacattccgcgctataatgatgctcgtaatttaattcgcaagcacgaacgtgatgagattatcgaggaattagttaaaaattatttggataaggaaacgacgaaataatgcgcttaatgggatttgatgtaggatcaagaacggttggcattgcgattagtgatctattgggctggacagctcaaggggtcgagattattcgcatcaatgaagatgaatcagaatttgggttagaccgcgtcaaggaattggttgcagaacatcaagtgactggttttgttttggggttacccaagaatatgaataattcgattgggccacgggcgcttaaagcgcaagaatacggggcaatgctgagtgaacttttcccagagattccggttgattacatcgatgaacgcctaacaacggttcaggctgaacgcatgttagtggaacaagcagatacgtcacgtaagaaacggaagcaagtgattgataagcttgctgcggtgatgattttgcagaactacttggacgcgcacggtcgcttaacacaaggctaataaataaaacaattaaggagttttgatgaatgactgaagataacaagaacatccaccaagatgaagaacaacaaattacactaatcgacgaccaaggtaacgaggaattataccaagtgctctttacatttgattcagaagattacggtaaatcatacgtgctattgtacccaacaagcgctgaagaagatgaagaagttgatatccaagctttctcattcacatcagacgatgcaggcgatgccagcaaaggtgacctattcccaatcgaagacgacgaagaatgggaaatggttgaagaagtactaaacacatttttggcagacgacaacatgaaataagtgcgtcaaaagcggttatcttgtgaggattagcctaacaaggcgaatgattgctgcaagcaatcgattgacttgtgtagctaaccggaacaggttgcttttgaaagcacgttatcactatctatttcaaaaagggtcccgatagcaattaattaaattgcagtcgggaccctttttttatgtggagaaggtgtgggttgaaacgtgctttttaaagctgactcttgtgcttagcttcgtattgcaaacgaccgactttgtcggtcattcacaacactgtgctaatgctcagagtcaacccgctttaaacgcactttaaacgtgctcctacaggcatatttctgcgcttaaccaaatttgccaaatcggcgattacatcgccaattcgtcaaatccagttaatgctcaaaatatcaccgcctgtagtcgcactctataacaatttctttgctttttccgtgttaataaaatgcaatttagcgaattcgcctaggtaatcgatgccaccttgtgcgagtaaatctgcggcgatttggttaactgcttgatgattgccaagcggaatttggcggcccgcttttttagacagttcaagcattgataggttggcttggtggcgcgcaatgattgaagcggcagcaacggcgaggtgaaattgttccgccttggttgagaaataaacgttctcgcgtaaaacaaccggttcattcttcaaatagttgtagtaaatgccgcgtggttcgaattgatcaatgaggatgccggcgggtttttcgggttggattttttggaggactttgaggagtgcgaaattatggctgatagccttcattttttcgatgttcattgtggcgtgtacttcattgtatttcggtggcatgatgttgacgatgtgataggggagtttagccatcatcttaatcgccatctgatcgatttgtgcatcggttagcgttttggaatccgcaacgcctaggctattgacgaacgccagattatcttggctgacatagacggcggcgatggtcagcggaccgaagtagctcccgttaccaacttcatctgagcctaaaacggaccatttggcaaaatcagctggtaaaacgtcgcctttggcggctttgggcttagtacggctagcagattttgctttgctaggggcagcggtgccccacttagcagcttctcgttcggcactagcgccttggaaaagtactttgccggatttatagccggtaatgcttagtccattggcttggtgcgcaaaaacggcccccggcggtagttgacggttggtcggataatttttttgaatagtagttaattgtgagggtgtcactttaatgactgcttgcatacgattggctccttaatgagtggcaaatgaagagattcggagtaaaattgccactttcccttatttcatgataaaatagttcagttgaactagcaaataaaattagagtgcgactgcagatggtcatactctgaggattagtagcataccgtgaatgaccggcaaggccgatcgtttgcggtatgctactaaccggaagagtatatctgcaggagcacgttaaaaaaagagtgcgacagcaagcgtttatattttgagcattaactggatttgacgaattggcgatgcaatcgccgatttggcaaatttggttaagcgcagaaatatgcctgcaggagcacgtttcaaaaatcagagtgcgcaataagctgggtatcttctgaggattagcatagactcgtgaataagcgacgaagtcgattgtttgcgaggcgtagctaaccggaagaagatggcttatggagcacgtttcagaatactttatccaatcaatcatacacacatccacgccacaaaacgcgtatctaaggggaactcatgttaagtctaattattatcttaatgctgttatatgccatttacacaggggtcagacgggggtttatcatgcaagccgtctacacgattggctactttatcgtcttttggattgccaaagcgatgagccaaacattagggcctaagctaagtttaatggtgccatacccatcggcaactgaagacagctattttgcatttttccaaaagagtatcgggttatcactcgatgatgcgttttatatcggcgtcgcctttgtcctcgtgatgtttatcggtggcttgttggtgcgcttcatcggactattgttgaattcattgacctatatgccaggtttgaagcaatttaacaaggcagccggtggactcttgagtttcttggttgtttacgtggggatctttttactcctctacgtgctggctttagtgccagttgatggcttacaaaagacattggaaaactcgacagttgcgcgtgtcattgtcttacacacaccagtcctcacctctcaagtgacgagctggtggattgctggctaaaatggatagtgcagttggggctgacggaagtcgccccttttttagaaggagctaacttaaatgaatcataaaatattacaaacactagaatacgataaaattaaacaaatgcttcaaggccatgccatcacggcgtttggtcaagaacaaatcacacaattaaccccttccaacgatgcggaattgattcaagaacgcttggaccagaccaaagatggggtcgatattgaacggctaaaaggtggcattcctttgccacagttagataatattcgtccgcacctgaaacgaatcgaaatcggtgcgactttaaacggtaccgaactcgcgcaagttgggcgggttttacgtgcgacttctgcggttgtgcgtttctttgatgacttagaaaaagatgaattaaccttaaaggcgttgccagacttagttgcccaattggtgactttaccgcaactaactgaaaagattagaagttctgttgctgatgatggcgccgttttagacacggcttcaaccaagttgcgtggcttacggactagtttaaaacaattggaaggccaaatcagatcgcggatggcaagttatacacacggtgctaaagctaaatatctgagtgattcgattgtcacgattcggaatgaccgctatgtcattcctgttaagcaagaataccgtggccaattcggcggcgttgtgcatgatcagagtgctagtggtcagacccttttcatggaaccacaagccctcatggaattgaataaccgcttgcgccaattacaaattgaagaacaacaagaaattgaacggattttggcggaattatcggaagccatcatgccagaacgccacaatattttagccaacgctgaattattggggcaactcgattttgtcaatgctaaggctcaacttgctaaagcgttgaaggccactgaaccgctgattaatttagaaaaccatgttgaactcaaacaagcacggcacccattaatcgacccagctaaagtcgttgctaatgacatcgcgattggggcggattatcaggccatcgttgttacgggtcccaataccggtgggaaaaccatcacgttgaaaacattgggcttagtccaagtgatggcacaatctggtttatttatcactgcgcgtgaagagagccaagtcggcgtcttctcggatatttttgctgatattggtgatgaacaatcaattgaacagaacttgagtacgttctcagcgcacatggaaaatatcattcagattcttcaacatatcgataatcgtagtttggtcttgctcgatgaattgggggcagggactgatccacaagaaggggcggctttagccatcgctatcttggatcaaattgggattgttggcgctgatgtcgttgcttcaacccattatccagaattgaaaatttacggttacaatcggccacaaacgattaatgctagcatggaattcgatattgctaccttacaaccaacgtaccgtttattaattggggtgcctggtcgtagtaatgcgttcgatatttcaacacgacttggtttaccaagtacaatcgtccaacaagccaaacaattgatgaacgatgaaagccaagatttaaacaatatgattaccgatctcgaaaatcaacgtaaggcagccgaaacggaataccaagccttgcgccatgaattatcagaagccactgatttacatcaacagttatccaacgcttatcaacaattcttcgaagaccgtgaaacagaaatgacgaaggcgaaagaaaaagcgaatgcaatcgtcgaaaaagctgaagttaaagcagacaaagtgatcaccaagttgcgggatatgcagatgaatcaaggcgcccagattaaggaaaatcaattaatcgatgcgaagtcggaattagggcaattgcaccaagaaacaaccttgaagaaaaacaaagtattgcaacgggcaaaacgacgtcaaacccttaaagaaggcgatgatgttttagttacttcatacggtcaacgtgggacattagtccggcaaatcgatgccaagaactgggaagttcaaatgggcattatcaagatgaagattgctaatgaagacctcgagaaacaaaaggtcgttgaagataatcgacctcaacgacacgtgacaactgtcaacagcggtggagcgcggcatgttaaagcccaacttgatttgcggggcaaacgctacgaagaagcaatggctgaagtcgatcaatatgtcgatgcggccttgttagcgaactaccaacaagtgacaatcgtccatggaaaaggcaccggtgcaatccgccaaggtgtccaggactacctaaaaggcaatcgccaagtcaaaaaatacgaatacgccccagcaaacgcaggcggcaatggcgcaacaatcgtaacattcaaatagagtgcggaagcaggcagttatacgccgaggattagcataggcagccgaatgaccaacttgttggtcgtgtggctggtgtagctaaccggaggagtatgcctgctggagcacgtttacgcccccaatccaaccagtcctttctggttttgagtgggggtgtttttttaggcttgttaaattaaacggggatgaaatagtccgtttgtaacgaataataagcgagttaagttgttatttacgccatataggagtattataaaaaataatatgttttgtacaattgaatggagggcgaagaataatggttgaagtattgacagataaaaattacgaagaagaaacaaagagtggcgttgtcttgacagacttctgggcaacttggtgtggtccttgtcggatgcaatcacctgttatcgaatcattggcagaaactaacgacaaagttaagttcagtaaaatggatgtggatgctaatccagaaacgcctgctaatttcggaattatggcgattccaacgttagtggttaaaaaagatggtcaagttgttgaaaaaattactggcttccataataaggaacaactagaaacgattttggcacaatataccgactaattatgaaaacacctactatttagtaggtgctttttttatgtgacagcgtgtgacaaaaatgttagtggttgtttaataaacgttgtggtaactttaatgatgaacaaaatgatgaaaatcaaaaagagagagaaagagatggtgaaaaaatgggtcaaaaaatacttaatttttggaataaaccggccgtcaatttcattggcaaaaccataatttattttgttattctgctaattctactttatttatatgattacagtggtatcggtagtcctaaatttatctacaatgaattctaatgaaggagcgtcgttaaaatgaaaaagaatatcattcaacaaattgatgcgattgcaattgaccaaccacaaactgtggcttatcaattaggcacgacgcaacacacttacgccgacttaaaggctgcttcagaccggattgctcatttcattcaaagccaagacttgccagctaaagcaccggtgattatcttcggtggtcaaaacttcgagatggtagcaacttttctaggtgctgttaaagcaggccatgcttatattccggtggaacaacattcagatccagcgcggattaaacagattgaatcagtcgcaacgccggctactgtcctatcatgggctggtgaaacagcgattgatgttaatatgcccgttttcgcagaacctcaattgacagatgtgattgcaaacggagcaaccgattatgatgctagccaaagtgtgcaagggaatgagaatttctacatcatcttcacgtcagggacaacagggttacctaaaggcgttcaaatcagcgaaagcaatttacaaagtttcgttgactgggccaacccagctttcaatgttgcggataacagccgcgttttaattcaagccccatactcattcgatttatcagtcatggatttatttcccgggttatgctcaggtgcaaccctcgtcgttttagaaaaagctgtgacggacaacttcaagacgttatttgaagtcttgccaactcttaaggtgaacgaatgggtttcaacaccatcttttgcagaaatctgcttattatcaccaacatttgatagtgaacatttcccagaattaaaacaattcgtcttctgtggggaagaattaacgcatcaaacagcaacaaagttaatcgaacgtttcggtgatgcgcaaatcttcaacacatacggcccaactgaagcgaccgttgcgatgacgagcatcgaaattacggcggaggtcttagcgacttacgaccgactcccaatcggctacacaaaggctgatactcaaactgtcgtagtggacgaacaaaataatccagtcgcagttggtcaacctggtgaactcttaatcagtggcccaagtgtttcaaaagggtacttgaataatcctgaaaaaacagctgcagccttcttcgaaaaagacgggcaacgcttctaccattcaggcgatttggtcacccaaaacgaagatggcttgctcttttataaagggcggaccgacttccaagttaagatgcacggttaccggattgaactagaggaaatcgaccaccacttaagccaattagcagccgttcatcaagcatgtaccgtaccgcgctacaacaaagcccatcaagtcacccaattgattgcctatgttgtgccagcagacggtcaagaagcgggcaatgatttaacgaagacgttaaaagcagaactcgctgaaaatacgatggactacatgattccgcaacgatttgtttatcaagaaaaattaccattatccgtcaatgggaagattgatcgtaaagcgttgattaaagaggttaatggcaatgcctaatttacaaccgtacgcgaatccgaactactttctcattctaggtgcggcgttaattccgttagtgattggcttacttaacggcaaacgttggcatgtttatgagacacttgtctcactgctctttttgatcctaatctttgacggggataaggttcaccagggaattgccttgattggttacgtcctgttcgaaggagcactgatttggggatacactgtctatcgtcaaaagcacaacaacacctggctattcgatctggctgttatcttagcgattatgccgctagtgattgtcaagttcgtgccattcttaaatccgggtagtaattcaattcttggcttcttggggatcagttatctgacatttaagtcagttgggatgattatggaaacccgtgatggcagtattaagaaatttgaaccatggttattcttacaatttatgctatttttcccgacgatttcatcaggaccaattgaccgttatcgtcgtttcaaaaaagattacctaaaagttcctgatcgtgaccattatctcgacttactgggcaaggcagtccacaacttcatgttgggctttgtgtataagtttatgctcggttacttattcgggaccgtgttactccctaaagttgcgcatttagcaatggcgagtcgcggtgggttccttgatatctcatgggggcttgttggttacatgtatgtttacagtatgtatttattcttcgattttgcgggctacagtttattcgctgttgcgacaagttatgtgatgggtgttgaaacgccaattaactttaacaagccatttgcatcaaccaatatcaaggaattctggaatagatggcatatgacattatcattctggtttagagattacatctacatgcgcttagtgttcttcttgatgaaacataagattaccaagaacaaggtcctcattgccaatctcggctatttaacactcttcttattgatgggcttctggcatgggttgacatggtactacattgtttacggcttgttccacgccatctggatcatccttaccgatgtctggttgcgtttcaagaagaaacacaaggatcacattatcagcaatcggtggacgaactacttagcaatttttgcaacgtttaacaccgtttgtctcagttttctaattttctcaggctttttggaccggttatggttccactaagacctacacactaaaggagcgatttaatcatggacgtagaaaatacagtagtagaaattttagcagatttaacagggaacgacgatattaaagacgatatggatatggaattattcgaatcagggacattagattcaatggcaactgtgcaaatgttacttgaattacaaggccaattagatattgaagtacctgtttcagaattcgatcgtgaagcatggtcaacacctaacaagatcattgctcgcgtaaaggaattgcaataaaatgtttaaacgtttatggcaaattttcggcccggttttagtggccggtctctgcttaacagccttattactatcacctcttcgattaggacgacctagcgaaaagacgttgtcgacagcggcgacgtcattatccgccaatgtgctaaaaggggaagccatcaaagatgctgcatttaacgacaactacattccgatgattggttcatccgaactatcccgaatggacgcgttacatccatctgttatggcaaacaagtatgattggcaaaataagccattcctactaggggcaccagggactcagtcattgacccactttttatcacttcaagcgactggtaatcacttgaacggtaaaaaggccgtcgtcgttatttcgccacaatggtttgtaccacaaggggtaaaacctgagatgttcgatttcttctattcaccactacaaaccagttatttcttaatccacgcgaaggattctgaaagtacgcggtatgcagcgaaacgaattctagaactcacaagtgatacaaccaacggggtaatgcgggatgcattgaagaacaaagctttaggcatacctttaacggagacgcaaaaagtatacattaataatgtgaaacgcccagcgttacaacatcaagatcaactcttcagccaattattcattcggggtcgtgaacgcgaattgcgtaaaggcttgaaggtgttaccaaaacaacctgataacatgcaacttgatcaagtcgcaacggaattaggacaaaaagtaacgggtgataatccgtttggcattcaaaatagtttttacaaaaaacgggttaaacccaatgttggtaaattgaagggtgaacaaagtcactttaactatgaaagttcacctgagtttgctgatttccaattgatgttagattacttcgcagcccataaagtatctgttcaattcatcattccaccagttaatgcgcgttgggccgcttatacagggctctcacaagcgatgttgaatcgttttgataagaagattcaataccaattgagaacacaaggcttcaacaacattgttgatatgactaacgatggtaatgaacaattcttcatgcaagatacgattcatcttggctggcgtggctggttgaaagttgatcaaaaactccaaccattcatgagaacgaaaaaagcaaaagcagtgcactatgacatgtcaaacgacttcttaagtcgcgactggcaaaacgtcagcggcaataacgtccatgactttgattagagtgagacagagccggttatcgcttgaggattaacacagaacggtgaatgatagcgaagcaatcatttgacgttcggggttaatcggaaagagatggctcaaggaacacgtttagattagagtgagacagagccggttatcacttgaggattaacacgtttaatatgctaagtattcaaaaagggtaggaacaaaatttaattttgttcctaccctttttttatagcacatgcttatctgtgttttctatgcatttctcgtcgacttggtaagtctgccacgcgggttcttgtgtagtgtggtgtttcttcagaagttggcttgttttctggttccaccggttcaggaacaactggtgtttctggaacggattctggttctagtgtgggagcagccacttcttcaggggctgcttcaacaggttgtgtcatcacaggtgctggttcttcttcaacagattctgattcacttggtacagatgcgacttgtgatgcatcaaccgttaaatgaatggcttcgactgcttcgtcttcaattggtgcttttgaatctgtttggacgaaaatcgttacgttttttttattttcaatggttgctttggcttcagtcacaatccgcaattgttgttcgaggatttgggcaacgaagccggcttctaattggaagtcaggagtatcgaaatccgcaatccgtgaagcgacaatcgggcctgttaattcgaagaagtattgttccttcttctgtttcttaagactgagatggccgaagttgatttgttcgaagaaggcacagaggtcttcgaaagaatcgagtgggaattgcaaagcgagttgcttaccggcccaatagctgatggcgtcattttcggccccaagaattgatggtaacaagatatcccgtaatgttgcctgtgtcagatatgatgcagtttgtggattttgggcgagttgttcatagcgtgattgagtcacagtggcactcctttatggttcgttttttataagtactcctattataccgcgaaaactctttattttttataaaaattaacgccaactgtgaattgccggccgtgcccgttgttttagttgaattttgcaccgaaaaaagagaaaatagaagttacgagtgtatcctgaaatgaaaagagaaatctaatatgcaaaaacaacccattggttttatggattcaggtgtggggggcctaaccctcttaaaagaggcgcttaaacgtctacccaacgaagacatggtctttatcggggatcaagcgcgcctaccatatggtgaaaagccggcggaaaccgtgcgcaaatttgcgtggcagatgaccaattttctacgggggcaaaatattaaagcattggttgtcgcctgtaataccgcaacggcggccgccttacctgatttacaagcgcaattgacgattcctgtaatcggtgtgattgcaccaggtagccaagcggcattggcaacgacccgtaatcggcatgtcggggtaattgccacgaccggaacgattaacagtggcgcatatgcctatcaactaaaggcactcaaaccggcgacacacgtcacgagtttggctgcgccaacttttgtaccgatgattgaagcaaaccaattgagtggcgaaactgtgcaaaacacggttgacgaaaccctcgcgccattaagtgggacgggaattgatacgctaattctcggctgtacccacttcccattattaaccgcggcgattcaaaagacagttggaccggcagtcacgctggttgaccccgcgcatgccgctgttgatagtttgattcaggcattacaagatcgcaatcagttggtggccgatgcaacagctgggcaactacacacctatacgaccggatctgtaaccaatttcgaagcaatcgcgcgtcaatggttagcaatcccaacccttgaagcccaacaagttatcattaaggaggaaaaaaacgatggtccgaatgaataatcgtgctgataatgatttacggccagtgcaagtcacttggcgttttctaaagcaacaacccgcttctgttctatggcaacgcggtgataccaaagtgctcgctgctgttcaacctacagaaggttccttgcaagtcaatggcaatggcataacagcgcaccaattagaatggttgcaaacgacattacgccccttattggcaaccgaagcactcactatcaccgtaacctgtcttgaagatggtggcggcttattagcagaactcttcaacgctgtttattgcgcactaaccttattaccaaaaggcaaaggccccaaacaagtcgctgcagccgtcacagcagcgatggtcgctggtgagtcactcggtgacccagacgccgcggaaagcgacctagcgactagcttggtgacgatggtggccacaccgcaggaacaaatcatcgcccttgaactcggcggacaacaagcagtcaatagtagtgaattcaacgaacttattttacgtgcgagccaaggtgtgacgcgaaccaatgatcaacgtcaagccagttttgaacgcgccgttcaaccgaatatccaagtggctgataccgatgaacaaacaatcgtgattgccacgaagaatccaggtaaggcccgcgaattcgaatccgtctttgcagcggaagggattcaaatcaaaacattattagattacccagaattgccaaacattgatgaaactggttcgacatttgaagaaaatgctcgcctaaaggcggatcaaattgcagcgatcttacacttacctgtcttggcagatgattctggtctaatggttgatgaactaggtggtcgtccaggaatttattctgcacgcttctctggtgatcataacgatgccggcaacaacgcgaagttgctctatgaattaacgggtgtgcctgctgaaaagcggaccgcaaccttccatacaacattggtttttgctaaaccagaccgaccagatgaagatttagtcgttgaaggtaacgtgaagggccaaattctaggtattcctcgtggggataacggcttcggctatgacccacttttctacgtgccagaattagatgcaacgatggcccaactcacggtggaacaaaaaaataaaatcagccaccgcgcaaaagcaattgagaacctagaagataaatggaaagaatggatcaaagactagcgtgcgacggcaggatcacgtttagatttggctgatgtagctagccggaagtatatgtcggaagaagcacgtttcaaaaaaaacaacgccccttggcgccgaaaggactgtttagtatgcgttttgttgttgtgagtgatagtcatggtgatcgcgatattctcgtgcagttagtggcgcagtatcaagatcaaccagtaaccatgttacattgcggggattctgaattaacaaccgatgatcccttgtttaaccaaatgaccgttgtgcaaggcaatatggatttcaatggtcaatttccagcacaagttgttgtcccagttgcaaatgaacgaatcttcttaacgcacgggcacttgtatggtgtaaatggcgatttaatgcggcttttattagcggcccaagaaagccaagctaatctcgcgttctatgggcatacacaccaattggcctgtgaaatgcacgaaggtgtgctgctcttgaaccctggcagcattgcccaaccacgggggcagttccgtgacttgaaagggacatacgccgttgtagacgtcacacctgaccaatatcaaatccagtactacaatcgtcggttcgaacccgtttcgcagttacactttacatttaaacgcgcctaattctaaagactatccaaagtttagtagctatggatggtcttttgtgtttgctctttgttacaatctaaaagtagcattagtttattggaggccaagtgatgatttcagatgcattttcgaacttattattagaaaataaagaacacttcttaattcccggtgaggttgttgcgagtgttcaagaaagcaactccttggaacatgcgtttattctactaaccacggtgaaatattcgagcattcccgtcttagacaaccattcgaagttcaaagggatgttgacgatgccgttaattaccgagacgatgctcggattgaataacctcagtttcgaaaatttgcggaagctgaccgttaaagatgtcatgcaaaccgatgtcgtgacgattagagatccatatgatattgaagaaacgctccatctcttagttgatcacccctatctgcctgtgatttcggatgaaggggagttcacagggattgttacccggcgcgaaatgatgaaaagcttcaaccgagtagcccataatatcgaaaaagaataccaaatcgagccaataaccgcagaaacaacccaaaaaggacaataagggttaaaaaagcgtcttccagacaccaacgaataatgtttggaagacgctttttgttttggactgaatccagcttaattactggtatatcaacatttgtaagcaaaattaagttagacgtaatgactttaaaaaatccatgatagtaggtcataactcatgagttgtgaacctcttatatcgttatatattgttcttgggtaatgatggttagatgactaatattcacccctgcataggcattcttgggagtctagcctagggggaagtagtgataccgtcaaagttatgcctgatgaacatagtcaaaatatcgaaaaattatcatgtaacaaagttttaaaggcattagaactgggaggaaatttgatatgcaaaagagagtcgtccatctaattttagcaattattttcttaaccactacaatcgtacagtcatttggtagcgcattagcggtggctatgaataaggagacggtgacagccaacacgacttctaagattgtgaacccacgaagcgcaattgaaggcgcgagctcagtttctgaaagcttagccagttcgttgcaatcacaatcgacaagcagtgcttcaacaagctcagatagtaagtcgagttcaaagagttctgattcagaatcgagttcaagtacttctgagaaaaaggaaagcgttaaatcgaccacgagtaaatcggtgattattcaaccacgatactggctttcagatttgactgatccgggcagtgaatatccagacttttcgattcctttatctggtcaaaacaacgttacaacgattgaagatgtagctaaccctgttgatggcaacggtgaccaaattgaaattccatatccttacaatgctttcccggtttatattcctggagtttcaagtgaaacagtgcatatgcctgctatagatgagtatggatcgcttgctggcgcgaaccttaaatatgatgaaaatggtctaattaaagataactacattgattataaaaaagtgatgatatataaagacagtgcggggaaaatgcattggattgatatgaagcaacggtttatcggatatgagaaacatggttggtataatgatgcgccggcatatcttgacaataactttacttctaatagcacgggtaaaaataatttaggtacattaatcaatgcttgggcaactactaagattggtaagggaacggataaacctggtaaagctcctggattattggggattacagggacttacgacgcgttgaatttcttccctgcttatattccaaatagtaattctgtcggtgatgcagcgatgcgattacctggatgtaagctgattcctgagacaacttttaagagagggtataatgaataaatcatctctcaaaaggaaggaatttttacatgccaactcgttacgacaaagaattcaaacaaaacattatcaacctatataagcaaggcgaatcagttgcccaactggccagagaatatggcattggctattcaacagttcataagtggatccagggccaggccaaaactcaatccggtaaatcgccagacgaaatcaaagttgtgtttagcataattatctaaggctaatttagcttgaagcggattgtcaccaatccctacagtggtgtataaaccgagtttttggcggatcgtcgtttgaattaaccgtgctacttcacgaacggaattgccaaacagacgccacgaatgggtcatatccaaaatgctttcatcaattgaatagggccaaacttccttttcagccgcaaactgatgaaaaacttgattaatctgcaaattacgttgaatataaaggttcatgcggggtggcacaacccatagttgcgggtcattgggtaagttatgtttgcggaagacattggctttgatatgaaataagtgtttagcttcgggtgacgtggctaaaattagtcctccattggtattttcaacacaatttttagctcaatcagacctttaactaatttacctgattgttgcaatttctatatgtagtgctataatgtaattctaaccaccatatatagagaaaggacgatgattagttacggaaaccataaatatcctctacatcagcttgagtggcaacacaaaatattttattagcagactgacaacatactttgaaaaagaacgtcatgttcgggttagttccattaatgttaaagaacaccctgaattcaccactcttgaccagccgtttgttaccttcctaccagccttcattaaaggtggtaatggggttaataacggttatactgaaatattaactactattttgggagattacctcgcgtacgaaggcaattaccagcattgctacggtattatcggtagcggtaatcgtaattttaataagcagtttgcactcacggctaaacaatatgctaaacgcttcgattttccttacattaccgattttgagctacgtggcaccgtacacgacattcctcgcattgccgatgccatcttaacctatcgcgatcaattttgttttcaaacaacaaaggagtaatccctaatgataactagcaccccagaaatggaaaatacctatttttacttaaataacctcgtaaatatcccaagcaacggagaaattccgctacattatgatcaagaagccctaaaggcttatttcgaagagacagttaaaccgaagaccaagcaatttgattcgttaaatgccaagttaaattacttggttgacgaagattatatcgatccaagtatcctggaacaatactctcacaagtttgtgcagtccttgttcgaccaaatgagagaccatcactttcgttttcgcagctttctcggtgcctacaagttctacacacaatatgccatgaaaactaatgatggccagaaatttttggaagactttgtcgatcgcgtcgtcttcaatgccctctatctcgctaatggtgatgaacaacttgccaatgacgttgccgatgaattgatttcacaacgttatcagcctgccacccccacgtttctcaacgcgggtaaaaaacggcgcggtgaaatggtatcatgttttttaatcgatgtggccgactccatgctctcaattggacgtggcgttaattctgcccttcaactatctcgaatcggtgggggcgtcggcgttaacctgtcaaacttgcgcgcctcaggtgattctattaagcagatttccaacgcctcgtctggcgttgtaccagtgatgaagttacttgaagactcatttagctacagtaaccaacttgggcaacggaacggcgccggagtggtttatctcaacgtcttccatcctgacatcttacattttctggataccaaaaaggaaaatgcggacgaaaaaattcgggtgaagaccttgtccctcggtttgattgttcctgataaatattatgaattactcaagactaacgaaccaatgtatctttttagcccctatgatgtcgaacgtgaatatcgtacgccatttgcttacatcgatatcaccaaagaatataacaacatggtcgctaaccccaatgttaagaagtcagtttttaacgcgcggaaactagaacaaaagatttctcaactccaacaagaatctggttatccttacatcttgaacattgatacggccaaccaaactaaccctgtcgatggcaaaattattatgagtaacctttgtagtgagatcttacagcctcaagaaccgtcaaaacttgatgacgacctatcgtacaagacaattggcaccgatatttcatgtaatctcggatcaactaatatcatgaatatgattgactcgccggacttcggtcactcagttgaggttgctgttcgtgcgctcaccctcgtaactgacacaaccgacgttaaggaagtaccgactgttaaacatggtaacgaactttaccacacgattggattaggggctatgggtctgcatactgcccttgcacgccaccaaattgagtatggctcaccagaggcccttgaatttactgatgcctacttcctagctttaaactactattcactcgttacgagcaatcgaattgcccgtgaacgccacgaaaccttcgctaaatttgaccaatcaaagtacgctgatggcagttacttcgatcaatacttgaacgcagactttaaatttaagagtaccaaagttgcaaaaatcttcaaaaatattaaattaccatctgttacagattggaaggcactcaagcaagctgtgattactggcggcctttatcatcgtaatagactcgctgtggcaccgaacgggtcaatttcgtacgtcaatgaaacaagtgcatcacttcatccaatcacacaattagtagaacaacgtcaggaaaataaggtaggctcaatcttctatccagcaccttacctgtctaacgaaactttgccttactacacacccgcatatgatattgatcaacgaaaaattattgacacctatgccgtagctcaaaagcacattgatcaaggtatgagtctgacactatttatgcgttcagttttgaaacctgacctttacgagtggaaggacaataacaatttaaagatgacaacccgagaccttaaccggttacggaattacgcctggacaaaaggcattaagtcactttattacattcgaacgtttacagaagacgatgaaattaaaacggcaaatgaatgtgaatcatgcatgatctaggaaattcacttggggtcttaccgtccgtttaacacaccggaatacgttattgggtcacaagacccatatacccatgaatcctaattaaggagacgaacaaataacgatggactatttatactacaaagcaattaactgggatgatattaaagataatttcgataaatacatgtgggaacgactcaccactaacttttggttggacattcggattcccatcacgaatgatcaaacggattggcagcagctatcagatactcaacaacaggccattactcgtatgttggcaggtacatcaatgttagccgtctaccaatcagaagttggcacccctgctattcgccacgatcggagaactcaacaagaagaatccgtattaaacaccattacctttatgaaatcagtccatgccaaaagctgtacgaccatttttcgggctctgattccgggtaacgatggtggaagttttacttgggcagatgataatgccaatctgcaagctgaaattgaccaactagcccaaacgagcactagcgatatggccttacagaaaaaagccctttttattctgactgaaactgggctctcgtttggtaaatactggacaatacttcaaacacaggatctcgtcaatacttaccaaatgttggctaatattctccgcggtagcgccctttttagtgcttatattggttacaaatttcgcctcagatttgaagaactcactgtaagtgatcaaaccgaactgcagtattggattaatacacagtttgatcaactcatgcaaactgaaaaagacttcttagaagctaaccttgacgatgccaccgaagccatcaatctggcctcctatggtgccaatcatgcattaatgtcacttggctttaacgctgtctacgaagttcaaccgtcttcactagtggcgcaactcaaagaactgatgattgaccaaaatcaatttttgcaacaggtaacggctgcaaacaatgaatcggacactgaaaaaatgaccgataacgactacgacttttaaggagcattcaactaatgagctataaaacaattaattgggacgtcatcgaagacgaacttgacgaatatgtatgggataaagcaacggcacaatactggctggatacgcgagtacctgtttctaatgatttacgggactggcagacactctctggcaccgaaaaatcggttatcaatcgggttgtgggtggattagccttgctggacacactccaatccgaagaaggagtcgacgtgctgcggcccgacgttcggacacgaaaagaagcagcagtcctcaatgactttttgatgatggagtcaattcatgccaaaagctacggcactattttgacatctttgaacgatcaagccactgttgacgaagtattcaaatggatgaacaataatcccagaatgcaatacaaagccaaacggatcaatgatatttatcaaacgggaaacaaccttgaaaagaaagttgcaagcgtctttcttgaaggaattttgtactacaccaacttttttaccccactttggtaccgtggtaacaataagctggcaaatctttctgaagttatcaaactggtgatccgcgatgaatctgttcatggtacctacctcggctacaaatttcaattgggatataacgagctatcggcgactgaacaaaaaacattcaaaaagtggatggatgagttgctcgacgatctccttgagaacgagtttgcgttcaccgaagaagtctacgcgccgattggtttagcggaagacgttaaacaattcgttcactacaacgccaacaaggcgctccaaaatatgggcttcgaatctcgcttccccaatgctgagattaaagatatcaacccaatcgtaatgaacggaatttcaaccgaaacggccaatcatgatttcttttcacaagttggtgctggctatctaatgggtaatgctgaagctatgagtagcggcgactatgacttctaacataggcttctaggcataattcaaatttaaaaaaagccaatgtccacaggagatattaaaggtgcctctgtcaaccggtgttgacgaagttatatttagaaaccaatttatttacgaattggtttcttttttcgattttgattccaatcccgaattcgataaataaaggttttccagttcttgtaatcatacgcggttcttttggtttgcttgattttacggttcacaccttctgcgaaatcatttgatacccgtccgtccattgaacatcttagagcgattaaagcactataacaaataaaaactatccacaacctgattgggaagggtgtggatagtttttttgtgaaaacgtgctttttaattgcaacaccttccgcttaatctaaaatgagccttaatctcaaaagacgagattgaggctcatttttaattaatgctcagaggcaaatcgctttaacagcactctatgctttgtcgaagtagattgttgcgattgtgcctaggatgatcatagcgatgatgagtgcgatgggtcctagtagtgctgtggcggttgttagggctggccaggctggtgcgacgccggtttgggcaagaatccagatggcggcaatgacaacgccgagcacaccggcgtaaacgtattcgacgaagtgtgctaataggtagtgcattaatttagcaacaatcacagttccgatgacggccccaatgatgaacggtaagaggagcgcgacgcttttgaacgcttctgtggcttgtgtcaagcgtcctgtgacgaggtagaccattaagtcgagtagttgactgacagcgtgataaacagtgccatattgcttcacaatcatgagcatgattgacccagagacgcctgggatgagcatgagtgatactgagaagaagccggcaaatagtaacgtgccaaagtcttggagggtagtgagttgtttgatagcgatgtcggattcagattggtgaccaccaatctgggtgagtagtagcataattgcgccacagacgatggcgattaacactttttgccagttgagtccggcgagtctacgccagatgaatgggagactgccgacgacaagaccgatgaagaaactgtatgccactagtggataagcggtgcataaccaaagaatgattttggtggagagtaagacgccgatcccagcgccaatcccgattggccataaaaagccaattgcttggcgccaatcttttttgaattgcgcgatagccgccagaagcggttcgtatagaccaacgataacggcgaaaatgctgccggatagaccaggtattacgagtgcgacgccgattagggcgcctttgagtgcgttaataagtggcataagcggttctcctttttatatgaggggacttttatttggtgggaattgtaacgggtgttgaaggtaatgggacaccagcttcattcaaggcttgcaagtaagcctgtaagaaagtacggttagtggcagcttgttcgccgttagtggtgtgcataacaatctggtaagcaaggacaccatctgcgagggtggttaccccgagaatcgtagggccatcttgtatttcaggatgtttgggcaccagttgcacattgacttcattgacggttgccgctaacagttgtaagtcggtgtcgggtaagatgcgaatgttaatcagaacacgcatatcattgcgggataggttgctgacgatcgagatattgcggttaggaatgaaatttaaggtgccatcgtaactttgaacttgtgtggttcgtaagccaatcgcgttgacggtgccttctaccgtaccaattttaaccatatcacccacatcgaattgttgttctgcgaggatgaaaaaaccggtaacgatgtcgttgacgaaaccttgtgcgcctaacccaatggctaaactgaagatcccagcgccggcaatcaaggtaccaacaggaacgccgagaacgctgagtagcgcatagagatagaagaaaatcacgaggtatgaaaaagcgttgaccatcaaagtataaatggtgttcatgcggttacttgagaaaccatcagttttgcggtattttctgaagctgcgcttaatgatgtatttacctaagcgattgatgaggtagaataaagcggagagtaggataatttgaaacaatccagcaacgagggtgctgagtaatttatcccagtcaattgaagtgatgtagcgcataaaaatattggtctgtttctgaacagattcgaccggagttggtgcggccgctaataaacgtgtgaacatgcgtgaaactcgttggaattagctactaccattgtaagtgattgctttgggatttttaatttctgttcggattaattatagaatttgccacctcttaacaaaacatgagttattaccaatgacgaaaaaaggcgaccggcaattgattgccgatcattgtgtcgattttatcggcgtgaactactatcaaccaatgcgggttcaagcaccagagaatccgaagttcccagcacaaacaccggaagacttatatgctaattatatttggccagaacggaagattaatccatatcgtggatgggagatttatccagaagcattgtacgatgtggcaatgatgatgaaaaatgattatcacaacattccgtggtacgtttctgaaaacggaatgggtgttgccgatgaagaacgctttatgggtgaagatgggcaaattcaagatgattatcggattgaatttatgcaagaacatctgacacagctacatcgcgcaattgaagccggtagcagttgttttgggtatcatacttggaccttcaatgattgttggtcttggttaaatggttatcggaatcgttatggtttctaccgtgttgatttggaccatgaggcaaagcgcacgatgaagaagagcggtcgatggtaccgtgaattgagcgagagtaacggcttttagaccaaagaaaaagaaccgacgcatcagtcggttcttttttgagttaaaagatatctgtttgaacatatttattgtgtaattcaaagaaatcataagtcgctaagttttcaatatccgcttcaccattgaagatggccgttgcagaaccagccaacatcaggttaattggtaaattatcacggaaacgagcgagaatcactggtttattgtgggcaaaagcataaccacattcccacatggtaccggaatcaggttcgaattcgccttcttcagatttaaaatccataacagcgactacgacgtctgcttggtcaatttgacgcgtatcgacattaaaagtagcgacttgccattcgaaagtaccgaattctgcatcaggataagggtgttggcctggtttgaaaagtgaatcagcatcaatcgttgggtttttaatgagtaaatcagccacttgatctaaccgatcgttttgttcgggactaaaaaatgggccagcgagataaacttgtttttttgagggcatgagagccgcctttctcgataatgttcgtgttttttgtagtaatttaagcttaaaaagctatttattcaattatatacgtacgaaaaataatattcaatatatgttctgcaaaaaaatacgtaaaacaaaaaaactgcttacgcagttttagtgaacgaacaagtaaataaccaatagaataaaggccacaactaagattgtgaacatgtaagttgaagcggtactaacagctttcttacgttcctttgatagtggtcggttcgctagtttcttgtattgcttcttagcaatttcaaattgacgtttatctttcatttgtatccctcgcttgtttcagtgtccctattatagcatggaatacagtggattgataattattgatgataagactggactttcaatctggaacaagctacgataatgctatattggagtataaggaagtaacaaatcatgaaattaaagacaactaaacaaacaactggacataaattatcagttgcagggattttgattacgatgggcgtcgtttacggtgatattggaacgtcgccattatatgttatgaaatcaattgttgaggggaatggcggtttggcaaacatcagccgcgattttatcatcggcagtatttcgcttgtcttttggacgttaatgttgatgacgaccatcaagtacgtcatgattgcattgcgtgcggataataatggtgaaggtgggatttttgcactgtacactttgattcgtaagcaagctaagtggctcgtgattcccgcgattattggtggggcgacgttattagcggatgggatgttaacacctgctgtgacagtcacgacggcgattgaagggttaaagggtttgccaattaatgggaacgttttaattaataatcaagatcaggtgattttattgacggtctcgatcttatcggtcttatttttcattcagaaatttgggactgatctaatcggtaaatcttttggtcccattatgttaatttggtttacctttattggtggcattggtttggttaacttaatgggggatctaacgatgctcaaggcactcaatccgtattatgcgattgaactactgtttagccctgagaataaggtagggattctaattttaggcagtgtcttcttggcaactacgggggctgaagcactttattcggatatggggcacgttggccggttgaatatctatggtagttggccatacattgcgctttgtttagtgttgaattactttggacaaggtgtttggttattacaacataaagatattgcggcatatcaacatatttctgatttcaatccattctttgaagtgatgccagcccaattaaaggtcccagcgattttactggctacaattgcggcgattattgcatcacaagccttaatttcagggtcatataccttagtgtcagaagcaatcaagttgcgcctcttaccacgaattaaggtcgattatccggctaagttaaaagggcaactctatatttcaatcgttaactggattctatgggcggtttgtttaatggttgttttctattttaagaactcagcgcacatggaagctgcctacggtttggcgattacgattacaatgttaatgacaactatcttgctattccattacttgggacgccgcgagaagaaatgggtattggcttatttggtactcatcttcttcgggacaattgaagttattttcttcatctcaagtgccgctaaattcgtgcatggtggttacgtgacagtcttaattgcggcgtttattctatcgatcatgtttgtttggtatcgtagtaatacgattaaggaaagtaatactttcaaggcaagtacggtttcattactagcttataaacaacaactacatgatttgcgagacgatacagcgttagctatgtatacgactaatttggtttatctttcaaaaccacagaataaaccatatgaaaagaatatggttaagaagaatattctttattctattttggataaacgaccaaaacgggcgcaagtttactggtttgttgcggtcaatgttactgatgaaccgtatacggcagaatataccgcagatacgcttgggacggactacattgtcaacgttcagttgtatctaggctttaagatggaacaaaaagtgaacatctttattcgtcaaatcattcaagaaatgattcatcggggagaattaccagcacaaccacaacgctacacaacaattccaaatcggaacgttggcgatttctcgtttgtgatcatgcaagaagatttatcaccagcaactcaaattcgagcaatggataaagggattgttcaaatgcgtttatggttagaaaaattcactgatacaccggcttcatggtttggattggactatagtgatgtgttcgtggaacgtattccgctagttcttggccgccaaaaatcggtctctaagtatcatttaaaacgtcgtgaataacatcaataaattagtttataacgcctaggacagaagattgtcctaggcgttatttgtgtaatagcagtcaagtaagcggtgtgcattacaattagcgcgggaattgccgtcattttgttacctgtttgtcatcaattgttatggttttgacatgtacaagcgaatataagatggtatattagtcccacgttaataaatcaaaacaacaaggagcacatctattacatgaaatcttttaagacattattgcttagcgctacattgacaacggctgcaacagcaggattacttttcgttggtcaatcaaaagcaagtgccgctactacttataccgttgcaactggggatacgttatcaacaatcgcccaaaaatttgccggtaacacagatttagtcaatcaaattgccacaacaaacaacattcaagatatcaacatgatttttgtcggggaacaattaacaatcgacactgaccaaacagcaacccctgttcaaacgacaacgccagtagttgttgcacaaccagccgctgttcaaacaccagcaccagttgttcaagcacaacctacagtgcaagctgcaccagttcaacaaacagctgctgttgcaccgacaactagttcagcgaaagaatggattgcgcaaaaagaatctggtggttcatactcagcgcgtaacggtcaaatgattggccgttatcaattaaccgcatcatatttaaatggtgactattcagcagccaatcaagaccgcgtcgcagatcaatacgtaacaagtcgttacggttcatgggatgccgctaagagtttctggttaagtaacggttggtattaaaatttaaggttcctttaacgctcaatcaaatttaatttgattgagcgttttttgttctctgagaaatcacacttgactaaatcgaatgtatgttcgtataattaagaggacataagatgaattaaagaggtgtgcctgatgcatacgaataaagaagtgattacgctagatcaaacaggattgagtttatatttaaatggctttggagttttagaattgcggcgattagcggtgaatcatagtgatgatttgattgactcaatgaattattactacaaccgcgataagtttccgcaatttatttatcgtcatctatcagccgtcaccttgattgagattaatcggtggcaacgcgaattagatgaacaagtgcgtcagattcaagttggggtgaagagtcgtgtatgactatcagaatgaaccacgccgcgtgattttaatgattgattcgaaatctttttacgcatcagtagaggccgttcggttgaaactgaatccgttaaaggctattttggtggtgatgtccacggagaaaaacacgggcagtggtttagtattggcagccagtcccatggctaagaaattatttggtatcagtaacgtaacgcgtgcccgggatgttccaattcatgataaacggttaatcattgagccacccaagatgaatttgtatatccaagagaaccagaagattaaccgtatttttcagcaatttacggcagaagaagatattcaaccgtattccattgatgaatcgttactagatgtcacggatagttggcaactctttggagcgacgccgtacgaagtcgcacgtaaaattcagctggctgtaaaaaaagaaacgggcatttatttaacggtgggaattggcgataatccgctacttgccaagctcgcattggatcttgaggccaaacggaatcacagtttgattgcagaatggcattatgaagatgtcccagataaactgtggccagtgacccagttagatgatgtctggtcaattgggcatcgtacggcagagaaactgaatcagaaacacattcattcgatgtacgatattgcgcatacaaatccctatcggttaaaacaagaaatgggtgtcatgggcgcgcagttgtttgcgtttagttgggggattgatcgggccgttgtgcggcataaatataaggccaaagagaagtcttatgggaatagtcaggtattaccacgtgattattttatccaagctgagattgaagttgtgattcgggaaattgcagagcaagtggctgcacgtcttagggcgcatcacaaggcgacaacggttatcagtctggggattggcttttcatttgctgcaaaagagggcgcatcgcgtggtggttttgggcgttcaatgaagattgatgcgactaatgctaatcagcaactcacaaaacatgccatccaactttttcgtgaagaatggcaacacgaatcgattcggcatattagtattgcgtgcagcaatttggttgacgatagtgcggaacaattagatatgttcgacacacagtttattaatttgaaaaagcagaaattagatagcacggtcgatgaaattcgcaagcgctacggttttacatcggtggtcaaattgtctagcaaagcaaaaggtgcgactgcaattgagcgtgctggcttagtcggtgggcatgctggagggaacgcctatgaataatgatgaatatgatcccaatttggttaatcaatttttgaagtatgattatcatgatcgtggcatgatgaaatggcaagggttctatttaagtgatcatacgtcagtgttagataagaataaccgcgtacaagatcgtaagtgcaatgaaaaacacattgaggcgatgactgctgagatgattgctaataccatcaatgacgcaattgttaaatgttatccggttcaaatcgacaaagcagaacgttcaatagaaggtattgtacccagtaaggtggaaggtttaatcagtggctggtttggtagccaaataattgtggcaaatgaagccattttaatagaagaaatctacgcaataaaaaaactagcccactaactaaagcgttagagggctagcttttttaaacggtttaaacaaacagaaaagccgttaaactaaggtttaacggcttttctgggttctaggctgttttaaatatcacccgtacggggatcgaacccgtaactccgccttgagagggcgacgtcttaaccgatttgaccaacgggcaatgttcggaacaactaatatcttagcgaataaagcctgtaatgtcaatggttaattgactctagcgaggctaaatgaagattttatagttacgacgattaatgttaataatttccttggtcatggtgcgatttgtttgtctctttaaatgtttcaagatattccgaatatagtcctgatggtttatcagtagatttagaatatcgttatcaattgtgacttcaagcgtcctgcgtgaatctatccaatcaatcacaacgtggtcttgatcatatacggcaactttcccgtcaaataatttttcgatttctgcttttttcatcattggaaccacctccaagaatagtatagtcctcttttaaagatttgttaaaaatcataattgacaacgtctggagtgtgcagtattatagtattcgttgatgatattgggtattcgccaaattggtaaggcaccggactctgaatccggaatttataggttcgagccctatatacccaattaagatagaaagagctgagtaatcagctctttttttgtggcttcatatcgatagggcagattatttgtagttctctgtctcaaacatgatttggatcgcatagcgatccgcaatcttagctaaagcccgtaaattgaagaaccaatagtgtgctaatagcttacttttgaaaattaatgttttgtcctgagcaccggaaatttgaatcattcgatcatccaatgcgacgtttaaatctaaatcatttaattttaaaactttcattttgatcacctcgtcttattattacgttaaatagggcgattatttttgaaagagggttaattaattcaaaatagcatatttagcatttttattgactgtaatccttggtgttattagcttttaggtcgattacaggtcaattaaattgtgggcttcattacaaagttaggtgaaattgccgtcattttgttacggatttgtcatcaattgttatggttttgatatttactaacggatttaagatggtatattagtcccacgttaaacagatagaaaattcaatttaaacaataaggagtctattcaaaatatgaaatctttaaaaactttactttacagtgccgctttaacaaccgttgcaacaaccgggttacttttcgttaaccaatcacaagccagtgccgcaacaacttataccgttgcaaatggtgatacgctttcaaccattgcgcaaaaattcaatggtagtacagagcttgttaaccaaatcgcaacaactaataatattgctgatattaatatgatctttgttggtgaacaattaacaattgatgctgatcaagtggcaacaacaccagccccagcccctgttgtaactcaacaagtagctgcacctgttcaaacaccagcccctgtagttcaagcacaacctgcagttcaagctgcaccagtacaacaagcacctgtagctgcacaaacaacaactacaacgagttcatctaaggaatggattgcacaaaaagaatcaggcagttcatattcagcacgtaacggtcaattaatcggtcgttatcaattatcagcttcatacttaaatggtgattattcagcagctaaccaagaccgcgttgcagatcaatatgtaacaagtcgttatggttcatgggatgtcgctaagagcttctggttaagtaatggttggtactaaactaaaataatgacaacgtctaggccattggtctgggcgtttttttatggtaagttagtgattggaagtgtaaactgaaagtagtataaagagtgaggcttgatcagatgaagattttaggagtgttaggcagtcatcaacgagatggggtcaatgggcaacttttagatgccgttttagcaggtgtaaaaccggaagatgacgttgaagtgatctttttaaatgattatcaaatattaccagatactggcaaagccaatccggtattggatgaactggaagctaagttattggcagccgatgtttgggtgcttgcagcaccgacttattggggtgcaatggcgggtgtgatgaaaaacttcttggattgtacgcggcaacggttagtccgatttaatcgggcgggagatgcgttaccagatcgcttcaaaggcaaaagttacattacgattagcagttgttatgccagtccagctgaggaattggttactggtgtgactgacgggacttttagaatttttgataaagtcttgggggcagctggacttttaaaaatccgggaagttgtccagacaaaaacgtatggtttaaagacactttcagcgcagaaacaagcggaatgtcgccaagtcggcgcaagcattcaatctaaagcaaagaggacggatgatacagtgaaacgatatatacaactatttggtatggtcgcttgtgcaaccttgattacgatgttactgcaacaattagtgaacttagtgttgccaattggccagttttggcttaattatgtgtcattcgttttaatcttcttcattctattagcaagtgtgttacacttttttacggtggttaaacaccgcagacattaggagggattcagatgaaaattgcattgattgcacatgatcgtcagaaaccaacgattgtgaaactggcgacggcttataaacctattttagcgcaacacgaattatttgcgactggaacgactggccaaaaaattattgaagcaactggcttaccgattacacggtttaagtcaggtcctctagggggcgatcagcaaattggcgcgttgatttcagaaaataagatggacctggtaatctttttgagagatccattgactgctcaacctcacgaaccggatgtgaatgcattaattcgattatctgacgtttatgaagtaccgtttgcaacaaacgtcgggacggctgaagtattgctgcgcggtttggacttaggactagtcgactttagaaaagtggtccatggtcaagatgtcaattcaattaatttatagtgtaaagcggattgtaccttatttcgactgtgaaatagtgcaatccgtttttttgatttcaattttaatttgcgtataataagagtattgatttggagggattgggttgcaaaaagaaataggatttcatgatcggctaagcacggcgatgtttttaacgtttcttggtggcttcttagatgcgtattgtgtgattttacgtggtggcgtctttgcgagtgcacagaccggtaatattgtgtttatcggcttagacatcgcaacgaaccagtgggcacaacttcctgaaaagatattacccattatctcatttgggtttggggttattattgtgcagctggcgaagcggcattttaacactggtgggttgaatgtttggcggttgtggttattagggtttcaaattattgctttagtagtagttggttttttatcaaccgcgattcccaacatgtttgtgacaccgattctgtcgatgtcgatggccatgcaattagcgagttattcaacggttaatggctatccatatgcgaatgcttttacgaccggcaattataagaaattaatcgagaatacttatctatatttagcgaccaaagaaaaaaactaccaacaaaaagcccggtacttcgggttaattgttggtagcttcttcattggtactattagctcagggttaattgttaagttaatcaatgtgcgcactgcatgggtagctgcgattatgttgacggtgttcttcggttttcaattgtattttacagaagaagtgattgctgagaccaaacatatgcaacgttagccgtaataataaacaattaacatggcaatgaaatatgcgccgcaaacagcagtgctaatccaactggcaatcagaatgatgggatgcgcaataaaggcacgcatgacaaagagaaacaaggttaaaatagcatacttaatacagctgacctttagctgttcaaaatgaggcttattcaaaagaaagatccactaaataaagttgacggtcactaagatgggcggtagtaatccacacatcttggaagccgtctttttgtttttcttcggtttgttgataaaaagtcgtcaataagtcatggtgttctttgacgtactcggggtcaatccggttaacgtgtagccgcatatcagggaacagtttttcggcatctggcagatcgacttggtcactaatgccaaagcgaatcacgttcgcatattgaaacggttctagaaccacttcatcaggatgttcttggatgtaagttaagatggttgttaatgcagacatagtcatgcttcctttctagtcgtttaaaaaatcgtaaagccagcagtaatgttattcaacatgtgtaaggcaatattactcttaatattatgggtgcgatagtagacgatagccagaattaggccaagcagtgcttttgaaatgaaataaatcggatcagttgcgccgtgcatcaatccgaataagatagcacttaacccgattgagatgattggtgtgtctgggaaaaaccaattcattaggaaccctctgaaaagtaattcctccataatcggacctaagaatagggcgtatggtagcatgaaaataccaatcgtctgaaagactgaggttagtgcatcaacattggcattaccggtagtatgcataaacgggatcgtaccgttattgacagcaaccatcgcaataaagccaatcaacattgtccaccaaatctgtttggtgaagggttggtcataacgcgttgatttaattttttggtagtaataccacattagggcagtaatgccgatagtcgtgattagaaaaagccaaccaaagactaaaatcagatgggttgtctgttgggccttagggagcaatgttaagccactgacaagcattaaaggaacttgttggatgataatcagaagtaaaaaggcaatcccatgtttgacgtgtttgataagcgccacctccgtgtgcttatcatagcatattcccgtgaatgaataaaagattgaatgcggattgctgttcaaggcacgatgctttatgttagattaaaacagttaagaaaggggtgtctggatgtatttagcaattaaagaaattaaacatgctaaattacgttattcgttgatcatttttacgatttttctaattgcatatttaatctattttttaacggggttggcatatgggctagccaataataaccgttcggcaattgatcaatggcacgccaaagaagttgttattagtcagtatgcgaataaaaacttggctgcttctgaattagatgttgatcaattaccctctattaaaggtgcacagaaaaatcatgcgcaacttgctcagatgatgggtgttgtgagtagttcaggtttaagtaagcaaaatacgagtgtttttggtatcgattttgatgcttttttgaagcctaagttgcaaaaaggacggtatcctaaaaaggcaaatgagattgtggtcgacgacggcttacaaggaattgctttaaatcaacaaattaaattgaatgggcgtcaacaaaagtacaaaattgttgggattacgacgaaccaccgctataatacgcaaccggtgacttatttgcggttgaccgattttagccgaatgcgctacggcactgatcagattacgcgcattaatgctttagtattaaagggaaacgcgcggattaagacaacggatcagctgaccaaactgacaattccagaattaatcgataagattccggggtatgggccacaggttaagacgtttggtttgatgattggcgcattgctagtcatcgtcgcctttatcgttgggattttcatgtatattattactattgaaaaaacggccgtatacggggttatgcgagcacaagggatttcaggtggccaattagttggtagtttaatgtggcaatctgtattcttaggggtgattgggattggccttggtttgttgtgtaacgcattgacaacattggtattaccagcggcggtgccgtatacaaataatcctttactaattggggccttttctgctgttttacttgtgatgacagtcattggcgctttattctcaatttggcggattctaaagattgatccgcttgatgcgattggaggggcataggatggctttaatgcgtttagaaaaaatcgtcaaaaaatttggcgcaggcgaccagcaaaccacggctttagatcaaatcgatttaacgattgaaaagggccagttcattggtttaaccggaccatctggttctgggaagacgaccttattaacgattatgggtagtttacaaggcccaacgagtgggaagctcttttttaaagatcaagagattagtcaattaagcgaaaaacagcggtctgcattacggtttaacgatttcggctttatattacaaagttcgaatctggttccatttttaacggttgaagaacaattcgaactagtcgatcgattacgtgaaaagcaagcgccacaatcagctgaacaactattaaccaatttaggtgtttgggatcaacgacgtcagtacccaacgagcttatctggtggtcagcgtcaacgagttgcgattgctcgggcattgtatggtcagccagatttgatttttgcggatgaaccaaccgctagtttagatagtaaacgggccttacaggttgctgagcagctggctaaaatcacgaaagagacgggacagacgattgtgatggtttcccatgatgaacgcgtcttggattatacagatcatcaatacgtgatgcgcgatggtaaactgacataatgcgactcataatcataaattttgactaatgttggttagctatcctatcatataggtagaccaataagaaggagtgattttgaatgacagataaagaaaagttagatggcatgaaagaccaagtaaccggtaaagtacaagaaacagccggtaaggtgactggtgatcgcgaaactgaggccaaaggtaaagcaaagggctttatgggtgaagctaaagaaaaattagcggatgccaaagacaaagttgctgaaaaaaccaatgacgtgatggatgatattaaagaaaaaatggacaaagacgataaatagcgccttttaaagggaaccggcagacgatagtctgccggttctttttttgtggatttaatgcttgcatgagtgcctaagttggcgtattatgacattacgtcacaattatgacgctctgtcattaattttcagaaaggagtatcgaaatgccgaagaaaacattttttagattacctgaggaaaagcaacaacgactgattcaagctgcgcatgctgagttttcacgggtaccgtttaatgaagcatctgtcagcaacattattaaaacggcggagattccgcgaggcagtttttatcagtactttgaagataaggcggatatttttttctacgaccttagcttattacgcgacagttcaaagcaggatttagaaaagagtctgttggctgttcatggtgatctattcaaggcaattcgccaattctttgctgaaatggcagaagagattattaatggtgaaaatgcacaattttacaagcacctcttcttacatatggattataagaaccggcgcaagatgttaccagaattaatgcatgccaaacaagtagatgggatgcgctttttagaagaaaacgtcaattacgacttgctcaagattaacgcagatcaacccgaagcgcttagaattttatttcatgagttgatgacgacggtctttcaaagtattgcagcgtattatctgcaacaagaaagtgaccatgcgattacaattgaacaggtccaagaacgcttcgaattagtattaggctggttagaaacaggggccagcaaacaaggataaggaaagaagggacacacaacatgcttaaacttgcaaagaaaagaatgtcaggttgggccgtctttggtgcggttttattcatgacgattcaggttgtcagtaacctttatttacccaatttaacctccgacattgtcaatgacgggattgctaaggggaatattgattatatctggcaagcaggctttaaaatgttaggtttttcattaattagtattatcgcggccgtctgcaacgtttatcttgcggcacggacgtcacaaggcttaggccaaaaattacgttcagatatctaccggaaggtcatcaacttctcacatgatgaaatggatcaagttgggacgtcttcactaattacgcggacgactaacgatgtggtgcagattcaaaatgtggcaatgatgttcttacggatgatgattatggcacctatcatgttgattggcgcaagtttcttagcgtatcaaaaagatgcgcaacttacatccattttcttggttgtcttaccaatcatggcactcttcattggtggggtgatgtacttcgctgtgccattattcaaggcaatgcagaaaaagacagaccggattaacttagttttccgggaaggtttaaccggggttcgggtcattcgagcattccgccgcgacaagttcgaacaagaacgttttgatgaagctaatactgactacacgcaaaatgcgaagaaagtttatagtattatgtcagtgatgttcccagcaatgacgttaatcatgagtggaactaacattgcgattacttggatgggtggtcatttaatcgccaatcaagcaatgcaagtcgggaatttattagcgttcatgacttatgcgatgcaaatcctcatgagtttcatgatgctttcaatggtcttcgtctttatcccccgggcgcaagcttcagcagtgcggattaatgaagtgcttgatttacacacgccgattgaagatccagcgacccctaagacgtttggtgatcaaccagcaagcttggctttcaaccaggtcaacttccgttatcaaaatgcggagcacttagcgcttgaaaacgttgatttccaaatgacagcgggccaaacagtcgccgtgattgggggcactggctcagggaagaccacgttagtcaacttgattcctcgtttttacgatgttgaaacgggtgaagtgacagtcaaagggttaaacgtgaaagatgtgaccctccatgacattcaccaacaagttgcatttgtccctcaaaaagcgaacttatttaccgggacgattcgggaaaatatgcaatatgggaatccgaatgcgaccgatgatgaaatctggcacgcacttgaaattgcacaatctaaagatttcgtcagcgaacttgaaggtggcttagatagtcacgttgaacaaggtgggggcaacttctctggtggtcaacgtcaacggcttgccatcgcacgggcgttggttaaaaaagcggctgtttatgtctttgatgattctttctcagcgttggactttaagacggatgccttattacggaaagccttaaaagaagatgctgaaattcaaaagagtgtcgttgtgattgttggtcaacgggtatcaaccgttgccgatgccgacaccatcttggtcttggatgaaggccagctggtcggtaaaggctcacatgctgaattgaaggctaataacgccacatatcaagaaattattaactcacaaatcagagagggggatgaagactaatggctgaaaaaacaacaaccaatcgaccccaaggtggacatggcccaggccgtggcatgggtggtgtcgttgaaaaaccgaagaatttttggggcacaaccaaacgattattaacctacatgtctagccggttaatcggattagtgattgtgttagccttagcaatcatctccgttattttccaaattagaacaccaaaagtattaggacaagcaacgaccgaaatcttcaagggtgttatgaagggcaatgccatgcaaaaagcgggcatgccgatgaatggcttaccaattgatttcgataagattcaacacattattatgacggtgattttgatgtacttagcatcagcggttttcagtttcttacaacaattcatcatgacgcggatttcccaacaaaccgtctatgaattacggaaagaattaaaagacaagatgcaacgggtaccgattaattactacgacacacactcaaacggcgatatcatgagtcgtgcgattaatgatatggacaacattgcaagtaccttgcaacaaagtttaacgcaaatggtaaccagtgctgtgacatttattggcgttatgtggatgatgctctcgattagttggcaattgactttaattgccttagtcacgattccactcagtttagtcgtcgtcgggattgtcgcaccgaaatcacagaaattcttcgcagcgcaacaaaaaagtttggggttgttgaacaaccaaattgaagaaaatttctctggtcaagtggtcttaaagaccttcaaccgcgaacaagtcacaattgatgcctttgaagaacaaaatgcattactctataaagcagcttggaaggcacaatttatttctggggtcatcatgccgttaatgacgttcgtcaataacattggttacgtcttcgtagcaattgtcggggggattcgtgtttctcacggccaagttactttaggggatatgcaagcgttcatgcaatatacgcaacaattctcacaaccaatcacgcaattggccaacttagcgaatacaatccaatcaacgattgcctcagctgaacgggtcttcgaagtcttagatgaagatgacatgagtgacgacccatcagaagtgccggcgattgttgatgaccaaaatctacttgaattagaacatgtcgaattcggttatcaaggtaaagatatcttgatgaaggattacaacttgcaagtcaaaccaggccaaatgattgcgattgtcggcccaacaggtgctggtaaaacaaccatcattaacttgttggaacgcttctacgacgtgagtggcggttcaatcaagcttaaaggtgtcgatacgcgcgatatgactcgggaacaattacggcgtcacttcgcgatggttttacaagatacttggttatttactggaacgatttgggataatttgaaatatgggaacgctgatgcttcagatgaagccattttagcagccgccaaagcagcgcacgttgacggttttgtccgtcaattacctgatggctatgagacggtcttgaatgaagaagcttcgaatatctcccaaggtcaacgccaattattgacgattgcgcgggcctttgttgccgatccagagattttgatcttggatgaagcaaccagttcagtggatacacggactgaaattcatattcaacacgccatggaacgcttgttgcaaaatcggaccagtttcgtggttgcccatcgtttatcgacgattcgcgatgccgataacatcatcgtgatgaatcacggttcgattattgaaaccgggacccatgatagtttgatggcacaagatggtttctacgctgacttgtacaatagtcaattcttaggcaacgttaaaatttaatcatgaatgacgcaaataaggccgcagataaaatctgcggccttatttttgtccgtgtttggcgtatactagtgatattgatgtagtaggaggaatttaacatgcgatttgaacaaaccatccggcaaattgaagcgctagttgatgaagggattgtccctggtgtttcttatgccatcatcgaaggccctgaagtgatgactaatgtaatcgggcaggccgaattagtgccccaaaaagtgccgttaaaagctgatcagttgtatgatttagcgtcattaacgaaagtgattggcacgacgacgattgttttgcggctattggaaaaagggcggctttctttacgaacaaaagtgcatagtttgttgccggcctttaaagatcgacgggtgacggtcttgcatctattgacgcacacgtccggtttaacgggctacattccgaatcggaatcaattatcggctgccgaattaaaaacggcgcttttgacgcaattaacggtcggcccaaattttggtgaaaaggttgtttacacggacattggtatgttgtatttgggctggatgattgaagccatctatcaaaaaccgattcaggatttgattcaagaactcgttttaaccccactcggtatgcaagccagtacgtttaatccggacaaaagtttggcggtcccgactgaattgagtgccgaacgcggcttaatccagggcactgtccacgatccgaaaagtgcgattttacaaaatcatagtggtgcagccggcttgtttgctccattaaaagacgttgtccgctttgcccagttccaattagggcagttgaaggttgaccagccaccaatcagtcaggcgagtgttaagagtctctatcgtgattggacaccaaaacatctcgggcgctcactgggctgggatttgcgctttgagccgcaagaacaccagccactgatttatcacaccggttttaccggcacgttcatgctattggatcgcaagcggcaaacggggctgattgtcctgagtaatcgcattcatccaacggctgataatccggtctttttggaacgacgggatgcgattgtggcacaatttttagcggataatcacctagaaacaaaagcctagtcaaattcgcaaatttgcgtattatccgcttacatttgtggtaaaatgggactattgataaataaagcgcattaggagtgagtgaattgacagaacctttatttctaaaatctgtttttcaagaaaaaatttggggtggtcgcaaattagctgaagccttcgattatgatttaccagacggcgatattggtgaatgctgggcgatttcagcacatccacatggtcccagcacaatcgaaaacggtcccttaaaaggccttacattagatcaagcttgggcccaacaccgcaattattttggtgatgccaagggagaagttttcccattattaacgaagattttggatgccgaagcaagcttgtcagttcaagtccatccagatgatgcttatgctgctgctcatgaaggtccaaccgaactcggtaagacggaatgttggtatattttggatgctgaaccaggtgcttatttaatctatggccaccatgccaagaccaaagcggaattaacagcaatgattgaagcaggcaagtgggatgatttactccgcaaagtgcccattaagactggtgactttttctacgtcccaagtggcacgattcacgcattgaacaaagggattatggcgcttgaaacccaacaaagtagtgatacaacatatcggttatacgattatgatcgggttgatgctaagacgggcgaaaaacgcgaactacacttgaagcaatcaattgatacgacgattgtgccgcatcaagatcccgttttgaatattcaaacagaacatgttggagattcaacaatcacgacttatgtgcaaccaccaatgtcaccatttttcagtgtttaccaatggttagtgaagggcgacttacactttgatcggacaacggcaccctatactttagtctccgtggtcgatggtgaaggcgaactgattgtcgatgggcaactttacccaattcacaagaatatgcattttgtgttaccatttgatattaagtcatgggacttaaaaggtgacatgcaaattattgcgtcagaaccgggtaacaagtaaactgaatataaccaattgcaaccgcagccgtggttgcaatttttttaatgattaaaagagtagggtggcagttatgcaaaaacaaattgaagcaattgaacaattcgtacgaacagcgttagctcaggagcatagtggccatggttttgatcacattcaacgggttgtaaataatgcccgcttaattcaacgccaagttggtgatggcgacttaacaacgattacattagccgcactattgcacgacgtgattgatgaaaaaattgttagcgatgtggcacaagcccgccaaagcgtagcggctgttttaacccaaaatggcattgaagagatgcaatcaactgcgatttttgacatcatcgatcatatgtcattttctaaaaatattaatcagcaccaagcattaagtttagaagggcaaatcgttcaagatgcggatcggttggatgcgattggcgcgattggtattggccggacctttatgtatggcggcgctcacgatggggtggcttatgatcctgaaattcaaccacgggccgagttaaccaaggctaattatcgggaaccttcaacggtgattaatcatttttatgaaaagctcttcaaactcgcggcgacgatgaatacgcaagtggcgcgagaaatcgcaaccgctagaacacaagtcatgcaagattttgtggccgagtacattgcggaatggcaaggtgaaaaataactaaaaaaagaacgttggctagaattacttctggtcaacgttctttttagttaatttaattctggttctgctaaccagtcgttttgtaagagttcatgggttttctttttgagggggagccagagttcagcgcgtaaaacgttcaccaatgattcccagaaaagccgatccttcttttgttgatcggtgatatgtagttcgataatttcgccggactcggttgtcgcgaggaccttatcttgactatcaatacttttaattttaacggattcaatgttttgtttttttattagcatatcgatcgctccttttaatctataacaacagtatagccggggaatgttatcaaacaattgatattttatgaataaaaatcggtttttttctttaaaaaaggttaagtcgtttccttaatctttagattatggtttggattaaactagctgtttcctcaatcgaacgatcggcaacattaattgtcgtggcgtttaattgttcaaaaatctggttggcataggcaagttcatcaccgacggttgtcatattagaataattagttgtttgcggtagtcccaaggtggccaaacgttcttggcggatttttagcagtgttgaaagtggcatggttagaccgataatcttatgggcgggcactttgaataattcttttggtaacggtacgttgggaatgagtggtaagttggccacgcgatagttttggttggccaaatacatactgagtggcgtttttgaggtccgcgaaacgcctaatagaacgatgtcggcttctaataaaccacgtggatcttgaccgtcatcgtaacgaacggcaaattccatggcgctaatacgatggaaatagtgttcatcaagtttccgtaatgagcctggggtttccagtgatgcggtttgactgcgttcgctaatggcggtggtcagcgaagacagagggtcgattaaggttaaatgcttggcttggcaaaattgcgtcaccgtttcttgaagcgtgtggttaacaagtgttgtgacaataattgcctgttcttgatgggcatcttgcaaaataggggttaatgttttttgatcggtaataaacggaaagcgttgaattttaagggtgactgaagcggggaattgggcgttgaccgctgcgataactgttcgagctgtttcgccaattgaatctgaaataataaaaattggaatcgctgacattttgtaatcctccaaaaaattatgattgatagtgcagtccagcttcgatgaaatagcgcataataattgatttggtaattttgccaatgacggtgatgccatcaatggcaacgactggcagtgaatcaacctgatgtgcaattaaccgctgaccggcgtgtaagacagttgtgtcctcggtggtcgttgtaatgtttggcattcgcgtcataatcatggcgactggagtagcttgcgtattagttgtattaatggttgcccgtagtaagtccttccgcgataaaacgcccagtaaacctgactgttcatccgttacataaagcgacccaacatcgtgcatgaatagttgcgtgaccgcttcatcgatcattgtcgtttgagggattaaaagcggtgggaccatcagttgaccgactgtttcttggtagagttcatcggttaagagcggcatcacttcttggccgacgtaaaagtagccgactttagggcgggcgtccaaaataccggtcatcgttaaaattgcgaaatcattacgcaaggttgcgcgagaaagatgcaattgttcagcaattttagtcccactaatgggttgattcgctttgacgattttgataatttcctgttgacggttagataattccataagcgctcctttgaataaaccgggttcaataaattcattataggatagcgttacgctaattgcaatatattcacataatagcgtgacctattaaaatttataagctacactattgacttgtaatgtgacacactatataatgcggttatcaataaaatttggaggcgctatcatgaactatatttatgcttttgctgaagatcaaacggtaaccaatcaagaattaggtggtaagggagccaacttagcggaaatgacgcgattaggattacccgtgccagccggttttacaattacaacggctgcttgtcgacaatacttagcaagtgctaaacaagagacgggctttttagaagacgaattaatgaaagcggttcatattcttgaagaaaagacgcagcggcaattagggaatgctgagcagccgttattggtgtccgtccgcagtggtgcaccaatctcaatgccggggatgatggatactatcttgaatttagggttaaacgatcaaacggtaatcggcttagctgaaatgaccaatgatccatggtttgcttacgattgttatcgtcggttgattcaaatgtttggggatgtggtttacggtattgataagccaatttttgaagcggcattaacggcgcttaaaaataaacggcaagttcaaaaggatacagacttaacgttagttgatttaaaacaattgattgaaacctataaaggcttgtacgtagcggccggacaatatcaatttccacagtcggttgatcaacaactgcgactggccattgaagctgtctttaaatcatggcagaatccacgtgcgcagacttatcgacgtttaaatcaaatcgacggtgccatgggaaccgcagtcaacgtgcaacaaatggtctttggtaattatcaggggcaaagtggaaccggcgttgcgttcactcggaacccagcaactggtgaacctggtttgtttggcgaatatttattgaatgcacaaggtgaagatgtggtggcggggattcgaacccccgaaccaattgcgacgttaaaggcgcaattgccagtaatttatgaacaattcaaaacgattgccaatcaattagaagcccactatcgggatatgcaagatatggaatttacgattgaagctgggcagttatatgtcttacaaacacgggttggcaaacgcaccgcaccggctgcttttagaattgctgtggatttagttgatgaaggtgtgattgatcggccaaccgcgattagtcgcttgaagccgacgatgattgatgggttgttacacccactttttgaaactagtgcggtgcaacaggcaacacagttattgactgggttaccagcgagtcccggtgctgccactggtgcggtctatttcgacgcccaaaaagcgcaacaggcacacgaagctggtgaaaaagtcattttagttcgccaagaaacatcaccagaagatattgatgggatggtgatcagtgaagcaattgttactagtcgtggtggtatgacatcgcatgcggccgttgttgcacggggaatgggctgttgttgtgtcgttggttgtcagcaacttcaagtggattatgaacaacgtgaggcgcattttgccggccgagttttaaaagaaggggcgattatttcggtggatggtcatactggtcgcctttatttaggggcgttgccccaacaaaccggtgttcatgaaacaacgcttgcaacggtgctcagttggtgtgatgagattgcaccctttgcggtttgggccaacgctgagacacctcaagaagtggcgactgcttttgaatttggcgcacaggggttaggacttgtacggacggagcacatgttctttggtccagaacgaatttttaaaatgcgccaaatgattttagcaactgaattagcggatcgccaagtggcgttggcggcactaaaaagcctccaaataactgactttaagcaaatcttttcattagctgaagagcgaccatgtacaattcgcttgttagacccaccattgcatgaattcttaccgcaaaatgaagtggaacaggctgaattagcaaccgcgctaggcattagtttggccgaaattaagcgccggattgctgataaagcggaggttaatcccatgttaggccatcgtggcagtcgtttggcggtgacctatcctgaaatttatcaaatgcaggtcttagcaattgttgagagtgccttagcggttcaaacaacgtaccaccatgttgtaattcctaaaataatgttgccgctaattggcacggcgactgaaatggcgtacctaaagcaactattacagcaaaccatcaacgactatttggtagaaaatcagcaacaactaacttatcaaattggcacaatgattgagattccgcgggcgtgtttagttgcggatcaaatcgcagagaccgcagatttctttagttttggcaccaatgatttaacgcaaatgacgtacggcttttcccgcgatgatattggtcattttatgccggattatcagcaacagggattaatgccgaccgaaccgttccaaacactcgaccaagatggggtcggtactttgatgcaattggcggttcaaaaaggccgtcaaaccaaacctgatttatcgattggcgtttgtggcgaggtcggtggtgatccagcagcgatgccgttttatcgtgatttgggcattgattatgtctcgtgttcaccataccgagtgccaagtgcccgtttggcagcggctcaaagtcaattaacattggcagattaaaatgcaaaaaaagaaccccgacaatatcgaaaaagatattgtcggggttcttttgggagtacttaattttggacctttttgacacctgctgcgtcgacttggtaacgggattcttcgattggaaggtccgctagtggttgaagatcaaactctgggaaacggcggctaatcgctgttgttaagagtcgtttagctaagacaccgttatgggttaagattgggccgtggaagtaagaaccaaaggtgtttttataaacacaaccttcagtgccgtcttcgccgttgttaccatgaccacgtttaacataaccaagtggtttttcatcttttcctaagaaagtccgaccgttatgattttcaaagccgaggtaagtttcgttaaattcacgattttcaatcacgatatcgccaataaaacggctgttatcttggctgagtgtatagtgatcaagggcaccaatcccaggaattttatcaccgttcgcaccgatgtagtagtggcccaataattggtaaccaccacaaatggcaagcattacgccgccattttcgatgtatgctgtgagtgcagcttttttactgttaagatcttctgaaataattttttgttcgaaatcttggccaccaccgaaaaggacgatgtcatagcggctagcatcgaaatcttgaccgatactaatgacttctgtttcagtttgaatgccaacttttttggcatagtaatcaaggactaaaatattaccaagatcaccatatgtgttcattaaattgccgtatagatgacaaattcttaatgtctgggtcatactgatagtcctttcttaatataattggcagctgccagcttcttacgtagttgtaaaacagcggtataagttgctaatacataaacatgtttggttggggctgcttcaatggctgccatcgttgcatcgagttctttggtttcgtgtaattgatctgccgtgacaccagccacttttagacggaaagcgatatcgtcaccgcgttcgccaccggtaatcacggttggaatgttgtgtttgagtaagtcttcaaactcgccatcccaaatccaactcgtatcaattccatcggcatagttagcgttaagcaacattgcgagtgaaaagtcttctggatcagaactgatcatttgtaagacttggtttaagccaaccggatttttaacgagtaccaatgtgaccgctttgtcttttaattgaatgacttcttgacggccaaagattcgtttgtcttcagtgaaggccttttgaattgctttcgctggaatatcaaagaatcgaccgacactataggctgcaagtgcgttatagatgttgtacatgccgccaattgaaatttcaaacggttcgttgttaatttcaaagtgtgaatttgtggggcgcatctgattgatggcagtgactgcttcgtctaattcaggtcgttggtagccacaattagggcagtaaaacttcccttggctggcataactgatgaatttgtaatgaatgatgtgatcacaaacggggcacaaaacgccgtctgtgttgcttggagccatcatttcgccatctggtaagtggttgaatccgtaataaatctttggattaggaagttcaaccgatgaaaagagaggcaagtcagcgttcataatgagggttgcctcaggaacgagtttgacgcccgctagaatcatattataagtcgtgtagatttcgccgaaacgatccatctgatcacggaaaatattcgtcatcacaatcgctttgggcttgatgtagtgacaaaggggttccacattggcttcatcgacttcgaggacggccaattgccgttgtcctttttgaggatgatctgctaaaaaggcggtggtcaacccttgcatcatgttcgagccactcgaattggtcatgatatgatcgtatttttgcttcaacgtctgcacagtgagtgcggtcgttaatgttttaccattggtaccggtaatgataatcacgtcgtagttcttggttaactgctttaacacagcaggatcgaacttggttgcgattttcccggggagggagctgccacctttcataaaggtatgtaaataccaatatgaaaaacgtcctgctgtaattgcaaatgagcttttaattgtcatgcttgccaccctttcaatgttcataatcatagcataaattctcaatttggacgatataaaaacgcatctgcaaataaaataagggaaactttagaatttaatagtggcgaatattgttgcctcgctgattttcaggtatactagattaaaatgtgcttaacataggggtgtttgagagtggcgcaattattttttagatatggtgcaatgaatagtggtaagtcgattgaaattttaaaagtcgcacacaattatgaagagcagaataaatcagtgatcatcctgacgagtgggattgataatcgcgacggggtggggattgtttcaagtcggattgggctcaaacgtgaggcgacaccgattttctcggatacgaatatctttgagttggtacaatcgactaatccggatgcagcgtgtgtcttgattgatgaatcacaatttttagaacggcatcacgtaatcgaagcggcgcaggtcgttgatgatttgaatatcccggtgatggcgtttgggttgaagaatgattttaagaatgaattattcgaaggctcgaaatacttattgctatttgccaataagattgaagaaatgaagaccatctgttggttctgtcgcaaaaaagcgattatgaacttgcgaatgagcgatggcaaaccggtttatacgggtgaacagattcaaatcgggggcaacgaagcatactaccccgtttgtcggaaacactattttaacccaccggtaacacaagagagtgaaaaggaaggctagtcattcatggataaaatgtttgaacaacttgatagtttgttagaccgctatgcggaattacaggaattaatgtctgatccagaagtgatcaacgaaaccagtcggtatatggaattgtctaaagaagaagcgggtttacgggaaattgttggtaaatacacgcgtttgaagactgtcttaaacgacattgcagaaagcgaagaattgttacgcgaatctaatgacccagaaatggaagaattagctaaagcggatttaagtgagttacaagatgaaaaggaacaattagaacaagacatcaagattttgatgttaccaacggatcctaacgatgaaaagaatatcatcatggaaattcgtggggctgctggtggcgacgaagccagtctctttgcaggtgatttgttgaatatgtatcaacgctacgctgaatcacaaaactggcaaactgaaatcatcgatgaaacggctacagaagtgggtggcttcaaagaagttgcgatgatgattaccggtaaaaatgtttattcgaagttaaaatatgaaaatggtgcgcaccgtgtccaacggatcccaaagaccgaatcacaaggtcgtgttcatacctcaacagcgactgttgcagttatgcctgaatatgatggggttgacgtgcagctcgatcctaaggatattcggactgacgtttatcgtgcctcaggtgctggtggtcaacatatcaataaaacctcttcagccgtgcggatgacgcatattccaaccgggattgtggttgcgatgcaagatcaacggtcacaacaacaaaaccgagtgaaggcaatgcaaatcttacagtcacgggtttatgatttctatgaatcacaaaatcaaagtgaatacgattcaagccggaagtcagcggttgggtctggggatcgttctgaacggattagaacatataactatccacaaaaccgagtgacggatcatcgaattggtttaacgttaaacaaattagatcggattatgaacggggaattaggcgacgtcattgatgcgttaattctttacgatcaaaccgaaaaattggagcaattacaagatggcacagctcacttatcttaaagccctgaattgggcttttttatttttagaagaacacgctaaagaacgtgaagcagcgcgctttttactactcggtcgtaaacattggacgacgacccaactggtcttgcattatcacgatgaaatgccgactgccgaatacgatcagtatcaagcagacttaaacgcgtttatcgctgatcaaccggcacaatacattttgggatatgctaatttttacggacgcgattttaaggtgacgccggcaacgcttattccacgacttgagacggaagaattggtagaatggatattagatgctacacaaccaaagaaccgaccacttaaagtgttggatgttgggacaggaacgggcgccattgcaattacccttgcctgtgagcatccagaatgggaagtgaccgcaattgatatttcactagaagcgattgctgttgcacaagcaaatgcgcgccaattaaacgcgcatgttaactttatcgtgggtgattttctaaccccagtgatgggccaacagtttgatgtgattgtgtctaatccgccatatattgcacaagatgaacggcatgtgatggatgcgtccgttttgaaatacgaacccgacttggccctatttgcagataataacggcttagcgttttatgaacggtttgctaaagaagtgcgtgcgtatttaaaaccagatgggcagctttatttagagttcggttatcagcaaaaagaggcgatcgttcggttattcgaacatgaatcgaccgatgtagcggttacaatcaaaaaagatatggctaattggtctagaatggcccgtgtgggttacgatttcaatcggaatttggtatgatgtaaatcagaagtagagtaaggaaggcctataatggaaaccaagagatacacagtagaacagattgaacaagcagcagcagatttaaaagcgggcgaattgatttcatttccaactgagaccgtctatggtcttggggcagatgcgacgaatcctgaagcggttaagaaagtttatgccgctaaggggcgcccaagtgataatccgctaatcgtgcatgtagcaagtgttgcgacggttgagcattacgcagccggagttagtgatcgatttaagcaattagtcgacgctttttggcccggttcattgacaattattttgccgctaaaacatgcggcactagattcagttgtgacgggtggtttaaagaccgctgcctttagaatgccgaacaatgcggtgacattagacttgattaaagcggccggtgtcccacttgtggggccttcagccaatacatcaggcaagcccagtccaaccactgccgatcacgttttacatgatctaaatggaaagattgccggtgtcattgatgatggcccaactggtgttgggttggaatcaacggtgattgatttaagtgttgcgacacccgttattttacgacccggtgttgtgactcaagaagccattgaacgtgtgattgggccgattatgacgaaccaccataaagttggcgcagctgaaacgccaaaggcaccaggcatgaaatacaaacactatgctccaaatgcgcaggtttacatagtgccaacgccagatgaatttccggcggcggttaaatgggccagtcaacaaaatgtgccatttggtgttatggcggttgatacggtgttagggcagttatctgacgttaggtttaaagatcagttctctttaggcgattctgtagtgactgctagtcaacacttgtttgaaggattacggtattttgatttgaatcctgaggttaaaattatattagtgcaaggcttcgcaaaagagggtgttggattagcgtatatgaatcgcctcgagaagtctgccggccaacaatactttacttcgaaataggcactattttaataggaagaggagtgattgtaaatgattgaacaaactgatccagcaatttacgaattgattaaaaaagaggaacaacgccaggtgcataatattgaactaattgcttctgaaaacattgtttccggagctgttcaagaagcacaaggtagcgtattaaccaataaatatgccgagggttatccgggcaaacggttttacggtggttgtgaatttatcgatcaaattgaatcactcgcgattgaacgtgctaaacaactttttaatgcagaacatgccaatgtacaaccgcactccggttcgcaggctaatatggcagtttaccaagcgcttttagaacccggtgataagattttagggatgaacctcacagatggcggtcatttaacccatgggtcaccgtttaacttcagtgggcaactttatcacttctatagttatggcgttgctgacgataacgaacgaatcgattatgatgcgctcgctgctaaagcggatgaaattcatcctaaaatgattgttgcaggggcatcagcatacagtcggacaattgacttcccaagattacgcgccattgccgatcatgtcggtgcctacttaatggtcgatatggcacacattgctggtttagtggcaactggtgttcatccaagtccagtgccatatgccgatgtggtgaccacaacaacgcataaaacgttgcgtggacctcgtggtggaatgattttgtgtaaagcagaatatgccaaagcaattgactctgccatcttccctggtattcaaggcggaccgctcgaacacgtcattgcggcgaaagctgttgcatttggtgaggatttacaacctgaatttacagcatatacaaaacaaattgtggccaatgcgcaagcgatggctgccgctttcgaacaatctgacttagtgcgtgtggtttcaggcgggactgacaatcatttaatgttactcgatttaacgcagagtggtttaaatgggaaggaagtccaagcgttcttagatagtgtccacattaccgttaataaaaataccattccttttgaaaaattaagtccatttaaggcaagtgggattcgaattgggaccccagcaatcacatcacgcgggtttaaagaagcggattgtgaattgattgcgcaattaattttagaagtgattgaaaaacacgatcaattagacgccatgacgcgcattagtgcagatgttttagcgttgacggatcgttttccaatcacacaagctaaatttttagattaattaatgaataccgctagttttttgatgctatttacgctacaatagtaaacagaattttacgcggaagggagagtgactcggagaaggttttctttggagccactctttttttgcgaaaaaagtttggactaaattcattgaatagaataggggcaaagtaaatggcaaaattcacagtattaaatcatccgttaattcaacataaattaacgattatccggaataaggatacgggtactaaagttttccgcgaagtcgcaaacgaaatcgcagaattaatggtttatgaaatcacgcgcgatttagcaatggaagacgtagaagttgaaacaccaatgggtcctgcaattgaaaaacaattgagcgggaaaaaattagccgttgtgccaattctgcgtgcaggtcttggaatggttgatggcgttttagaattaatcccagccgctaaagttggtcacattggtatgtaccgtgacgaaaaaacattacaaccccacgaatactttgttaaattaccaacagatatcgatcaacgacaactattcatcgttgatccaatgcttgcaactggtggctcagcaatcatggccatcgatgcccttaaaaaacgcggcgcaacgtcaatgcgccttgttgtactagtggctgcacctgaaggcgttaaagctgttcaagaagcccatccagatgttgacatctatgcagctggtcttgatgatcatttaaacgaggatggatacattgttcctggtttaggggatgcaggcgaccgtcttttcgggactaaatagccgttaattaggtaccgataataaaagcgcgcaacacttgattttcttttgttacgcgtttttttgttgccaaaaaagcaaccgttaataagttcaatcttttgatatgataatatttatggtatttgagtgcgttgacaaaaaaataattagaaattagttagtatttgctttgtacttttaatttaatggtggtattatcatacatgtattgcggtgatgatttatgcttaatttttctacataaatattgctgtttttaggttcgttgtgcaactcgcgtagacgtagtcattgatagagtggaatcaacaaataagcctaagggaggagggaattttgtggatgataaatatcccattattagcattttgggaattcgttttaatttagcaaactgtctatcggtcttagtaagtgcagttttggtttttgcactcgttttctttttatcaagaaaaattgcgcttaaaccgactaaacggcagaatattttggagtggatcattgattttacgaacggaatcgttaaaagtgcgatgcccggtgaagaaggtaaacaattttacttatttgcattcgtcatgttcatgttcgtatttatcagtaatcaacttggtttgattcttcaaattaaggtacatgatgtaacttggttgaagagtccaacggccaatccgattatcacgatgtcgcttgcgatgatcgtcttagtgattgcgcactactttagtgttgaacggttagggtttggtaattacatgaagagttatattaaaccggtaggatttttcttaccaattaatatcatcgaacaatttaccaatttcttaacgttgtccttgcgtttgtacgggaacatttttgcgggtgaagttttactaagtttattagttaaaatggccttctcacatggaccagcaacgatgcttgtgacggcaccgatccaaatggtttggcaaggattctccgtctttatcggggcgatccaagcatatgtatttgtaacattatcgatagtctatatttcagaaaaagttgaaatggaagactaaaaattaggaggaaaaaacatgaactatttagcagcagctatcgcagctggtttagcagcattcgcagcatcatatggtaacggtaaggttatctcaaaaacaatcgaaagtatggcacgccaaccagaattatcagcagaattacgctcaacaatgtttatcggtgttgggttgattgaagctgttccaattctttctatcgtcgtttctttcttgatcttatttagttaatccgagtgaatctaaattttcgctttaaaaattagtcagtaagtcaaggaaggagtgtcaatagatgtttagtaatttaatcgttggtgcttctgaagcctaccttggagattcacttttcgtattagttgtctttatcattttagtcgctttagttggtaaatttgcgttcggacctgtttcaaaaatgatgcaagctcgttctgacaaaattacaaacgacttagataacgccgctcaatcacgtgaagacgctgctaaattagcagcacaacgcgcaacagagttgaagaattctaagtcagaagcagttgaaattgtgaatacagccaagcaaaatggtgaaaaacaacgcgaaggcatggtcacacttgctcaagaagaagtccaaactttaaaacaaaatgctaaaaaagacatcgaacaatctcgtttagatgcgttaaacagtgcgagagatgatgttgctcaactatctattgaaattgcttctaaactcattaagaaagaattgtcagttactgatcaaaagtcattgatcaattcctatattgaagggttggacaagcaaaatgaaactagataaatatgcagtcggacaacgctatgcaaaggcattattttcccttgcagaacaagagcaacaatttgaaagtatccatgaagagatacaagcactcgagactattttcaatgacaacccaagattgggtgcagttctgactgatacgactttatctggattgaaacaacgtgagcttctaaagagcctttctggtgaatttagtacactcatgcaacactttttaagccttgtttttgactatcaaagaatggctgagatgccatacattattgcggcctacgaagatctttatgatcaaaagatggggattgcacacgctaaggtaacgtcagccgttgctttagatgatgatcaaatcgcaaagattagccaaagctatgctaaacgcgaaggtctcaatcaggtcttagtggaaagtatcgttgatccagatattattggtgggattgtactggaatcgaatcacaaggtgatcgatggcagtgttaaacatggcttagatcaaattaagtcattactattgaaatagtcaatcgttgataaagaggtgaacctgatgagcatcaaaactgaggaaatcagtgcattaattaaacaacaacttgcaaattataatgaagatttagccgttgaagaagtcggtactgtcacttatgttggtgatgggattgcacgtgctcacggtttagaaaacgccctttcaagtgaattgctagaattttctaacggttcatacggggttgcacaaaacttggaaaccaacgatgttgggattatcatcttaggtgaatatgaaaacattcgtgaaggtgaccaagttaaacgaacaggccggattatggaagtgcctgttggcgatgctttaattggtcgtgttgttaatccattgggtcaaccagtggacggcaaaggcgaaattaaaacggacaaaactcgtccaatcgaaaagaaggcccctggcgttatggcacgtcaatctgtttcagaacctttacaaacaggtttgaaagccattgatgctttggtaccaatcggtcgtggtcaacgtgaattaattatcggggatcgtaagactggtaaaacatctgttgcgattgatacgattattaatcaaaaagatcaagacatgatttgtatttacgttgcgatcggtgaaaaagaatcaaccgttagagcgcaagtggaaaccttacgtcgttacggcgctatggattataccatcgttgtcgaagctggtcctagtcaaccagcaccattactctacattgcaccatatgctggtgcagcgatgggtgaagaattcatgtataacggcaagcacgtcttaatcgtctatgatgatttaagtaaacaagctgctgcttatcgtgaaatttcattacttttgagaagacctccaggccgtgaagcttaccctggtgatatcttctacttacattcacgtttattggaacgggctgctaagttaagtgatgaattgggtggcggttcaatgactgctttaccaatcatcgaaacacaagctggggacatctcagcttatatcccaactaacgttatttccatcactgatggtcagatcttcttggaaagtgatttattctattcaggaacacgtccagcgattgatgctgggtcatctgtttctcgtgttgggggcgcagcgcaaacgaaggcgatgaagaaggtttctgggacattacgtcttgatctttcatcataccgtgaacttgaagcctttacgcaattcggttcagacttggatgctgcaacacaagcgaaattaaatcgtggtaaacggactgttgaagttttgaaacaaccacttcacaaaccattaccattcgaacaacaaacaacgattctttatgcattaacacacggctttattgatgacgttccagttgacgatatcatgcaatatgaaagtcaattgagcgattatcttgaaagtaacgcaaaggacttgatggacactatccgtcaaaccgctgcattgccagatacagataagttagatgctgctatcaaatccttcacagaaggttttgtcggcgctgaagctactgctgacaatcaagactcaggacagtaaggggtgaattaattggctgaatctttaatggatatcaaacgaagaatcgcctctactaaaaaaactgggcaaattacgagtgctatgcaaatggtctctggtgcaaaactttctcagattgaaaaaaattcaatcgcttatcaacaatatacgaataagattcgagaaatcgtcacgcatttggctgcaagtcaattaattgcaagtgcacgtcaaaaaagtaccgctaaagcagcagaagctactaacggtacttcacagaaatcattgcggcatgacattacgttaagtaatttgttagtggaaagaacaatcaaaaagaccggttatttggtcatcacgagtgatcgtggattggttggcgcttataacagctcaatcttaaaagcaatggttgaaatgatttcagaaaaccacaagtctgccgatgaatatgctattttagcagttggtggcactggtgctgatttctttaaagcacggcaaatgaacttatcctacgaatatcgtggtgtaagtgatgtgccatcatttaatgaagtccgtgaaatcatcaaaacagctgttgcaatgtatgatagcggcgtgtttgacgagttgtacgtttgttacaaccaccatgtcaactcactgacatctgcttttcgagctgaaaaaatgctacctattaccgacttggatgtttcagaagtcactgataaagatcaagaatacatcacagaaccttctgttgatgatgccttagatgccattctaccgcaatacgctgaaagtttgatttacggcgcactacttgattctaaaacagctgaacattctgcttccatgacggcgatgaagagtgccactgataatgctaataatttaatttctgatttatcaattaaatttaaccgggcacgtcaagcacagattactacagaaatcaccgaaattgtcggtggtgcggcagcattagaataagaaacgcgggaggaaaataacaactatgagtatgggaaaagttgtccaagttattggccccgttgtcgatgtcgaattttctttagatacgactttaccagatatcaataatgccttggttgtcaacaaagggaacgacgaatctgtcgtcttagaagtggcacttgaattaggtgatggggtaatgcgtactatttcaatggaatcaactgacggtttacgtcgggggatggctgttgatgacactggtcgtgcaattaacgtaccagttggtaaagaaactttaggacgggtatttaacgttcttggtgaaacaatcgatgacggcgaagaatttcctgcagattttagacgggacagtatccaccgttctgcgcctaaatttgaggaattaaatacaagttcagaaattcttgaaacagggattaaggttatcgatttacttgccccttatttacgaggtgggaaaatcggtttgttcggtggtgccggtgttggtaaaaccgttttaatccaagaattaatccataatatcgctgaagaacatggtggtatttctgtctttactggtgttggtgaacgaacacgtgaaggtaatgacttatactttgaaatgaaagaatcaggcgttttggaaaagacagccatggttttcggtcaaatgaatgaatcacctggtgctcgtatgcgagttgccttgactggtttaacaatcgctgaatacttccgtgatgttgaaggccaagatgtgttattgttcatcgataacattttccgattcactcaagctggttcagaagtttctgccctattaggacggatgccttctgccgttggttaccaaccaacattggcaacagaaatgggccaattgcaagaacgaatcacgtctactaaaaaaggttcagttacatcaatccaagccatttatgtgcctgctgatgattatactgatcctgcacctgcaacaactttcgcgcatttggatgccacaactaacttggatcgtaagttaacacaacaagggatttatcctgctgttaacccactagaatcaacttctagtgctttggatccagaaattgttggcgaagaacattacgaagttgcttcagaagtgcaacacgtcttacaacgttatcgtgaattacaagatatcatctctatcttagggatggatgaattatctgatgatgaaaagattatcgttgcgcgtgctcgtcggattcaattcttcttatcacaaaacttccacgttgccgaagccttcacaggccaagccggctcatacgtgccagttaaagatacagtggcaggcttcaaaggcatcttagcgggtgactatgatgatgtccctgaagaagcattccggcttgtcgggaacattgatgctgcattagcaaaagctaaagaattgggttatacaccatccgaacaagaaacgaaacaagcttagaaaggggcgttaatgatggcagaagaacaaaaggtattaaccgttaatatcgtgaccccaagtgggattgtctatgatcaccacgcaacattgttggttgtaccagcgatggccgggcaacttggtattatggctaatcatgagccaattattacccctttagaaattggtgagattcgcgttaaacggactgatgatccagcacgtgaagacgcaattgcggtcaatggtgggttcatggaagtgagccataacgttgcttcaatcgttgccgatagtgctgaacgggcgcgtgatattgatattacgcgtgcgcaaagtgccaaggaacgtgctcaaaacgcaattaaaacagcgtccgaacataatgatactgacgaattacgccgggctcaaattgcactgcagcgtgcgatgaaccggattaacgttaaaaatcacttattgtaggattcaaaaagccttaaacctgaatggtttaaggctttttttgtttcttaagattcagtctggtgggcagacaaatcctatttcggtatgttacaatgtttgcatatcacaaaaggggcgttatttaagtgcaatcaatcgggttacaggcagttatttcaattattagccatattggttttattttaatcagtttttatggcttacaatcaatccggtttgagcaatttttcaaaccgaatcatgtccgtcaagtacagattgtcatagtatttctcgctattgtgatgggctacaccgttagccaattctttttagaaataatcgcgcaggctaaaaatgtgatttttttagtcccataaactagcagtcttattcggagggaaactcttggaaaaattgattatacaaggcggtcaacgattagttggcgaagttcaaatcgaaggcgccaaaaacgcagtattaccaattatggcggctgccttactagcaaccgacggacccgttcaattaacaaacgttcctattttatctgatgtcttcatgatgcaagatgtattaaagagtttagatgctaaagttgagtttgatgaacaacggaaccaattaacgatcgatgccagtggtgatttgaattttgaagcagcttttgaatatgtttcaaaaatgcgtgcttccatcgttgtgatggggccgttattagcgcgcttaggtcacgcacgagttgcgatgccaggtggttgtgctatcggttcgcggcctgttgatttacatttgaagggttttgaagcacttggtgcaaccattcatcaaaatcatggttacattgaagctaaagcagagcgcctagtgggaactaatatttacttagatttccctagtgttggtgcgacacaaaacatcatgatggctgcgacaatggccgaagggacaacggtgattgaaaacgttgctcgtgaacctgaaatcgtggatcttgctaatgtcttaaacaaaatgggtgcgaacgtttttggcgccggaactgagacaattcgggtggaaggcgtaaccgctttacacgggacggatcacagtatcgtgcaagatcggattgaagccggaaccttcatggttgccgctgcggcaacacaaggaaatgtcttgattaaagaagcgattgctgaacacaataaaccactcctatcaaaattagtggaaatgggtgcggaagtgattgacgaagaagctggtgttcgaattattggccccgctgaattaaaggcatgtaatatcaagacactaccttatccaggctttccaactgatatgcaagcacaaatgacgacactccaattacttgctaagaagacgagtgttatgaccgaaacggtatttgaaaatcgtttcatgcatttggaagaactccgccgaatgaatgcggattatcaaattgaaggtcaatcagttgtgctttatggcgatacacatttcaatggggctgaagtggctgcaaccgatttaagagctgccgcagcacttgtcattgctgggttagtagctaatggtgaaacattggttacgaaccttcaatacatggaccggggttactatcatttccatcaaaaattacgggcacttggggcacatatcagtcgaactgattttgatgctgccggtcaccggattaaacaagcaaaacgtgcataaaacagactggcggcgcctgctatttcagcggacgtcgcttttttattttgccaaatcaggatactaaaggtacctgtgttatggtataatgatttactgaatatagttctcggaaggagcaacaccaaatggctaaagatatcgggattgacttgggaactgccaacgtcttaattaacgttaagggaaaaggcattgtcctaaacgaaccttcagttgttgcgattgatacccaaaccaaaaaagttttagcagttggctcagaagcgtatcggatggttggacggacacctggcaatatccacgctgtccgtccattaaaggatggggtcatcgctgatttcgacattacagaagaaatgttagcgtattttattaataaattaaatgtaaagggcttcctatcaaaacctaatattttgatttgctgcccaacaaatattacatcaattgaacaaaaagcaattgttgaagctgctgaaaaatcaggtggcggcaaagtcttcttggaattagaaccaaaagtcgcggctgtaggtgctggcatggatatttttcaaccacgcggtaacatggttattgatatcggtggtgggaccagtgacgtcgctgtgctttcaatgggtgaagtggtcacaagtcgttcattgcgtcttgcaggcgataagatgaatagtgaaattgccgcatacgttaagaagaaacataatctattaatcggtgaacatacggctgaaacaattaagttaacaattggtaacgtttggcatgctgatgcgagtgagtcacttgagattcgtggccgggacatggtaagtgggttgccacaatctgtctcaattagtgcagatgaagttgaatcagccttgcatgaaacaatgatggaaattattgcggctgccaaagaagtgttagaagtgacaccaccagaattatctgcagatattattgatcggggaatcatgttaacgggtggcggtgctttattacgcaatatcgctagcttattctcagaacatttgaaggttccggtggtcttagcagaaaatccattggatgctgttgctttagggactggcatcttattagataatattgaagataaacgcgcttattaagccgcattctattaaagaaggattgtgattgtgtgtatcaatcaaattttgacgaacacgtcaaacccgttttaaagaaaattttattggttttcgtgctcataattattgcgttattagttggtcagatgattggttttgcaattggcggccagaatccatttgccgttttcttgcctagcacatggagtcatattattaatttcttgcagtagcatgcgctaaagtgaggcagataaattgcggaaaatattgattggattggtccgtttctatcagaaggggatttcaccattattaccaccgagttgccgatattacccaacatgttcgagttacatgattcaagcaatccaaaaacatggtgctattttgggtttaatcatgggcatcggtcgtatagcgcgttgccacccgtttgtacggggcggctatgatccagtaccagatcacttcaccgttttgcgcaatcgacagcaagacgagtcacaaaagtaagtcaaagaagttaggggttcaacataactatgtcaaaaaaagaacaaaaaattactgtcacaattgatgacatcaaacgtaatggccaagaaatgacaagcgtcatggtcggcaaaaatgaaattggcgtgattgtagaagatagcgctaagaaacgttttgaagcaactgttgaagggactggtcaaagtatcattactaagacccacgacgatgcagttaacgaattactacgggagtaccacttacaccaaggttaattcttaagaattaattagaattacagtaacccggcagaattctggccgggttatttatataatgagagcagaattgattgaaggagacttagcatgccaaaggaagtagaaacaacagaagattcctcgcgagttgattatggaatcgtcttttcagtctttatgctagcgttgattggcttgatgtcaatctatgtggcaacgtcacatgatacatcaggtgcgagttcaactcgagccgttattatgcaagctgcatggtacgtgattggtggaattgcgattgtcgcaattatgcagtttgattcagaacaactatggcggattgcaccactggcttatgggttagggattttcctcttgattgccgttttaatcttttataatcgggcagttgccttgcaaactggggcaaagagttggttctctcttggaccaatctcatttcaaccgtctgaagtcatgaagccggcatatattttgatgttgggcagagttgttacacaacacaatacggcttatccagaacacacgattaagacggattggatgttacttggacgaatgttactatggacacttccagtgatggtcctattgaaattacaaaatgactttgggaccttattagtgttcgttgccatcttaggtgggattgtgcttgtctcaggtgtgacctggaagattttagccccagccattgctgtcttagtcgctgttgggggcacggcccttacactagcggcgacgacccctggccgggtaatcttgacgcatctgggctttaaaacgtaccaattcaatcgaattgatgcttggctgcatccttttgataatactgccagtaccagtttacaattatcgcagagtttaaaagcgattgggtctggtcagctatttgggaaaggcttcaatcaagtgcaagtccatgtgccagtacgtgaatccgatatgattttctctgtcattggggagaacttcggctttgtcggttcatgttttgtgattcttttgtacttcttgttgatttaccaaatgattcgggtcacatttgatacgaagaatgaattttacgcgtatgtctcaactggggtcatcatgatgatcttattccatgttttcgaaaacattgggatgagcgttggtttattaccattgacagggattccattgccgttcatctcacaagggggctcgtcattattggggaacctaattggcgttgggtttatcatgtcgatgcggtaccattataagagttacatgttcagtgaagctgaagatactttctaggagtgaatgacggatgacgatgaataataatgattatttttggacagaggaaattgcagcatcgattagaagaattgggatcaccaaagccgcacaaaatgagtttgggttaatcaagtttgttgatgtcccaatcgtggggcaaaaattgacggctaatgaaaccttagtggccattgaagctgagaagatggtacaagatcttgacagtccactagctggtgaattagtaaacgtcaacacaccgttagctgataatcccgaattattaaatgcagataacgaaaaagatgcgtggattgctgatattcgggtcgattaggccattacttaaacaataatttgatttttttgaatagtcttgcttgacttttaattgaactttaattatgataggtactacttaatacaagcgatgaaaagatgagtaatttagtcagtagcattttaagagagtccggtcaggtgcaagcggataatgtgaaagctagatgaatatggtctttgagcaattcatttggtaaggtttaactgagccgaatgcgggggttgcccgatatagcgaacgagtatcaatcgggtactttgtaaggcgattactgtgaggtaatcgtaaattaaggtggtaacacgcatttagcgtcctttctctcatttatttgagaggaaggattttttttggcattttttaaaagaagagggagcgattagtatgttgacattaaaacaagtgggtaaaatctttgagcgagaacaaaaaacattcgccgcactaacggatgtctcgttgaacattgaagcgggcgaaatctacgggattatcggttattccggcgctggtaagagtacgttgatccgactcttgaatggacttgaaaagccaacgactggggatgtgctcgttgagggccagtcaattgtggggttgagcgaacaagcaatgcggccgattcggcagaaaattggcatgattttccaacactttaacttactctggtcaaagacagtgttagaaaacatcatgttgccactaaaattagccggggtacctaaggcagaacgacaagccaaagcccgcgcattattaaagattgttgaattgacccatttagaagcggcctatccaagcgaactatcgggtggtcagaaacaacgggtcgcaattgcacgagccttgattagtgacccaaagattctgttatgtgatgaaccaactagcgcccttgatccgaaaacaacgaattcaattttaacgttactggctaagattaatcgtgaaatggggattacaatcgtccttgtcacccatgaaatggatgcggtgcggcggatttgccaacgaattgcggtcatggaaaatgggcggttaatcgaagaagggactgtgcacgaaatctttgagaaaccacaaatggctgcaactaaggcatttgttgctgaatccttagtggtatcaccgagtgaaacggtcgcttcgattgatcaactgttagaacgggttccaaatggcacaatcgtccaactgcgatttaacgaagaacaatcgagtcaaccggtgatcggtcgcttgatgcgtcaatacccagcagtcgaaatcagtgtcattagtgggagtttacaacaaaccattaatggcgcacttggctatttatacattcaaattcaagctgatccaagtgatttaaaggcagtccttgcagaattagcacaacaaacaatcgaagttgaggtggtacgtcatggataacgtaaacggatttcaatcctattttcaatttaagcaagtgaactggccaagtatgtggcaagcaacttttgaaacagtttggttaacaattgtcagtgttttattggtggcagttcttggattcgcactcgggttagttctttatcaaacaaacgcgagtggtggtcgagtgaatcggctgttgaatggcattgtggctttattcgtcaacgtctttcgttccattccattcatcattttaatcgtcttgttgattccattgacaaaaggtttgatgggcacgatgattggcccgaaagctgcgattccagcgttaatcatctcagccgcgcccttttatgcacgactcgtcgaattagcttttcgggaattcgatggcggcgtgcttgaagccacccgttcaatgggcgcttcaaaagcgcaaatcgtttggcaagtccttttaccagaaagcatgccggcgcttgtttccggcttaaccgtcaccgcaatttcacttgttggttataccgcaatggcgggggtgattggtgctggtggactgggaaatcttgcttaccaagatggtttccaagctaaccaaaatgcgattacgttagtcgcaaccgtcattattttaatcatcgtcttcatttgtcaaaaaacgggcgacttggttgtccaacacattgatcaccgttaatttaaaaggaggagttttcatgaaaaaacgcagtttaggattattagcagcagtcttcttattagcgggcgcacttgccgcttgtggtaacaaagaagcgaagtcagacagcaacacaatcgtcgttggggcatccgcaattccacacgccgcgattttgaaacacgttcaaccggagttgaaaaaagaaggcatcaacctcaaagtaaaagtcttcagcgattatgtattacccaataaagctttagcgagtggcgaattagacgcgaactactaccaacacaaaccctttttgaagaaggccaataaagataacggctacgacttagtcagtgttggcagcattcacttagaaccgctcggcttatacagtaaacaagttaaaaaattgagtgatgtgaaatcgagtgcgaaagtattagtttcaagcagcaagccagactggggccgtgttttaacaattttaaaagacggtggcttaatcaccttgaaatcggacgtaaatgctgaaaacgcaacgtttaaagacatcgctagcaatcccaaacacctcaagtttgagtacacattcgaaccaaaactcatgcctgaacttttgaagaatgatgaaggcaccttagtggcgattaactcgaactatgctgtgcaagccggtctcaaccctgaaaaggatgctgtggcccttgaaaagcaatcttcgccatttgccaacattgttgtgacaaataaaaaagaccgcaataacccagctatcaagaagctcgttaaagcgctcaaatcaaaatcaacgcaagaatggattaagaataaatggcacggcgcagtgttaccagttgaataatgatcaaagacaagtcattaagacttgtctttttttgctgttagcatgtgtaattcttaacttaattggaaaaagcgggttaaattggatatactatcattgaatataaacttttagggggagtaagaatgagtcgtccgtataatattggtttagatattggtactagttcaattgggtggtcagtggttgatgaccaaagtaagttggtcagtgtaagaggtaaatatggttatggggttcgtttatacgatgaaggacaaacagccgcagaacggcgcagctttagaacaacacgtcgccgattaaaacgacgtaaatggcggttaggattgttaagagaaatctttgaaccctatatcacgccggttgatgatacttttttcttgcggcaaaaacaatcaaacctaagtccgaaggatcagcgaaagttatatccacagacaagtttatttaatgatcgaacagatcgggcattctatgacgattatccaacgatttaccatttaagatataagctaatgaccgagaaacgtcaatttgatattcgcgagatttatttagcgatgcatcatattgtgaagtatcgcgggcactttttaaatgaagcgcccgtctcatcctttaagagtagcgaaattaatttagtggctcattttgacagactaaacacgatttttgctgacttgttcagtgaatctggctttcaactagagacggataaattggcggaggtcaaagcgctcttattggataatcaacaaagtgctagcaatcggcaaagacaagcattatcactgatttatacgccaagtacgaataaggcagttgaaaagcagaataaggcgattgcgacagaattattaaaagcaatcttggggttaaaagcgaagtttaatgtgcttactgggatcaaagccgaagatgttaaagcatggacactcacttttaatgcagaaaactttgatgaagaaatggtcaagttagagagtagtcttgatgataatgcccatcaaattatcgaaagcctacaggaactttattctggtgttctattggcgggaatcgttcccgaaaatcaatcattgttgcaagcgatgatcacgaagtatgacgatcatcaaaagcatttaaaaatgctaaaagcggtacgggaagcgttagcacctggagaccgacagagattaaagcaggcttatgaccaatatgttgatggtcaagaaaatacgaaggcctattcgaaggaagatttttacggagatatcacaaaagccttaaagaacaacccagatcatccgattgtgagtgaaattaaaaaattaattgaacttgatcaatttatgccaaaacaacggaccaaagataatggggcaattccgcatcaactacatcaacaggaattagaccggattattgagaaccaacaacaatactatccctggttagcggaacttaatcccaattctaaacggcaaacagtcgctaaatataaattggacgaattagtgacctttagagtaccatactatgtggggcccctgattacggctgagcagcaacgacaaagctccgatgcgaaatttgcgtggatgattcgtaaagcagaaggccggattacaccgtggaacttcgatgataaagtggaccgtcaagcatccgctaatgaattcattaagcgcatgacaacgactgatacttatttattggctgaagatgtactccctaaacagagcttaatttatcaacggtttgaagtgttgaatgaattaaacggacttaagattgatgaccaaccgattacgacggagttgaaacaagcaatatttacggatttatttatgcaaaaaataacacttttatgtccgtattcttgacataggagcctttttttgttgcacttaaagtgtaaattcaagatacattacacaagatgtactagaataaagaaaaacaagaagaatgaccgtagcaacggacaaaggtttatttttttttaataaaaatagcgctatcataaacataaggaggaaaatatgactggttatatgaatcagatattgaatgctttgttaaagaatggagattacatgacagcaaatgaattggccaatgtagtcgccgtatctcaaaaaacgatttacaggtcggttaaatcgataaatgagacttataaaatgactttagttgaatcagagcgtggaagaggttatttgttaaattaccagaattatttacaaataatgaagcaaagtcccgaaaaagattatatcgcattctcgccagttgagagacgaaatgtaattatattaagttgtctattcaatgcaccattcacgaaaagtatagaaaatttataccataagttttatgtgagtgaaacactgattcaacaagatgtaattcagatgcaacaagatttaagtaagtatgaattattactacattatgaaaaagggaggctttccatatctggtaatgaagaatctattcgtagggcaatcaataatgcactcattcaaaatcatgcaatgaaacaggaaacaattagcgattttgttcatgaatttaaagatatcaatttttatgataatcaatttttaacaacccaattagatttaattcaaaggttgttaaagacgattattccatatccctataatgttaatatatattctcatctctatattctaattaaacggtttagatctggaaaagtcaacgaattggtagaaattaataatctggatgaagatgaacgtagaataattaataattatcaatcagttatgaaggtttcagaaagtgtaattagaaatacgggtgattatctaaatactaagttaccaagtattgaaagttattatttgttacaatatttaatctcaatgcgctataaacatgatttaactttcaatgagcaggtgcagccagaggtcttagcgcttactaaagcatatattagcgggtttaatatcactatgaatgatggaagagtgctaacccttcaaaatgatttaatcagtcacattaagccgatgttaaaccgcttgaataataggatacttattgtaaatagactaaaaaaagatattcagacaacgtatacaactttatttaataaagttactttaatttctcgtaagtatgagcaattagagagtactgactggcgtatatcggatgatgaggtaggctttatcacactttatttcgctaaatattttgaagaaaatcaaactaaaaaacgaatactgattatgtgtgctagtggaattggaacatcaaaactattaagagtaaaagttttgcgagctttcccagaggtagaaatcgttgctgttgtttcaaagtatgaatatgaaaaaaatattgaacgttattacgatatcgatgcgattatttcaacagttaatatcgaaacccaacagaaagttcaagttattttaaccagtgcgatgttcactaaacttgatgaacaacatgttaaagaggctttgtatggcaatttatattaaacagattaaaagtagagtgacaaagaaagatatctttcaaataataagaaatagcgctacgcaaacaaaaacaatcgatttatcggatacaataattcaagacttgatactaagagagaaagatagttctactagaatagcgaaacatactgttatgccacatgttatcgcagattatgttcaaaaaaatatgattttaattattcgtcttgaccatcctgtccaatggcttgataaaggcgaagtgcagacaattattgtgttactaattagacaaaatgattcttatttggaaacatttttagaaatgtgttgtgacgagttatttttaaaagaattaagccaagcacaatattcagtagcagatatacaattattaatagataagaaggaaaagtaaatgttatttaataagcaaattattctctttgatgaactagttgaaacaagacaagaagccgaatctttgcttgctgatcagtttatgctggaaggtgttggaacagaacagtttggtgaatcgattttaaaaagagaggctgaatttcctactggtcttaatacagaaaccgttggtatagcaattccacatactgattcagataaagtattgataccacaaattggttttatgcgattaaagacacctgtaacatttaagcaaatgggcgataattctccggtggcagttaaattaattttcatgctagcacttaaaaagtctgatgatcaattgaaaatgctacaaactttaatggctttgtttcaagattcacagaaggtagatagattacttcgtatttcagataaacaggaatttttaaaaataatgaacgccatcgggattaaataaggaggagtagtaatggagacgattactaatggattacagtggtttgttaatttgggtgcaagcgttatgttaccaattatactgtttatatttgctttattttttaaaattaaacctagtaaggcttttaaatcaggcttaacaattggtatcgggtttattgggttaaacttaatcattggtctcttaacgaaaaatttggggcctgcagctcaggatatggtgaaaaattttggtttacatttgggaacaattgatataggatggcctgcggcttctgcaattgcatatgggactgttctaggtagtttagcaattccagtaggtgtattagcaaacgttgtattactattctttggacttaccaaaacattagatgttgatgtttggaattattggcacattgcatttacaggttcactagtttatatagtttctcatgattttgcattaggtctatttacgatggtcgtacatgtcatgattatttatttactggctgatatggcagcaccagcaattcagaaaacttatggattagaaggcatttcgtttcctcaaggtgcttctgctccaggttatctattagcattaccgttaaattggctaatggatcatattccaggaattaataagattaaattaacacctgaaacgattcaaaagaaaatgggaatatttggtgattctggtgtgatgggtttaattatcggaattgtgattggtgttttagcgcggtatgacatcactaagacgcttcaactaggtgtttctacggctgcagttctgattttgatgccaagaatggtttcgttattgatggagggattagcgcctatctcagaaggtgctaatacatttgtaaaagctaaattcccaggaagagatttatatattgggatggacagtgcactagcagctgggaattcaactgttctatcatcagctttaattctagtgccattaacattgattattgcagttatcacgccaggcaattctgtcttaccatttggtgatttagcgactttaccatatatgattgctgtaatggcagctgttttccgcggtgatatttttagaacaattattgggggcattgttaatattgtcgcaagtctttatatcgcttcatgggtagcaccgttagtaacacagtcagccaaagccgcacatttcgcaatgcaagggaattcatcaatttcagtgctcagcgatggtggtgtttggacaacttgggttattgtgggactgggtaagacaatgagttggggaggtatcgggataattggaatagttactttagcaattatggtctggtacaacaaatttagaagtaaaaagctagttaaagctaattaaaaaataggaagtgaaacgcaatgaaaaaattaatgattgtttgtggtagtggtattgcaacatcaacaatagcagagggtaagattaaggaatatttagaaaaagaaggtgtacttagtcaagtacaaacatataaagggaacatagcagaatatattaatcaaattgatgattatgatggatttgttagcacaactattgtacctgataatgtaaaagataaagtaatcaatggagtgccattattaagcggagtaggagttgataaggtttatgaacaaataatgactaaattaaatttaaaataaaaaagaagattctaagaattcaatttcttagaatcttttattttggctattgaaatattattatttaagatactttcgcgatttcagggttgttcctcctcaacatgcgttatactattagtcagttactattttgatcaattgaagtaagaggaattttaaatgcaaaaaaaactagttatcaccgaaaaaccaagtgttgccaaagagcttgctaaagttctaggaacaactcagaaaactaaaacctattttgagggcgatcaatacgtcatcacttgggcgtttgggcatttgttatcgctgcaattaccagaggatatcaaaaaggaatggcaacaatggcgtttggaagacttaccgattattccgaaacatatcggtttaaagccattgcctaaaacgggtgggcaattaaaagccatcagtcacctcgccaaccgcaaagatatttcaggtgcggtgattgcaactgattcggggcgtgaaggggaagccgttgcgcgctatattttggaatggattaaattcgataagccggttgaacggctctggatttcatcgcaaacgactaaggccattaaagcagggtttgcaaacttaaaaccagccaagcaattcgataatttgtacgcatcagcgttagcacgcggcaaagcggattggttgattggcttgaacgtgacacgggcattgacgaccaagtatgaagataatttatccgctggtcgggtgcagacaccaacgttagcctttgtgaacgaaacggcacaacaaattaatcgttttaaaccgcaaacctactacacaattcacttgacggtcgatcaacagcaagccgccttacaattagcaaatccgcaaagtattaagacgcgccaagcggcagacgacttagttgcacaattgcaacaagccaaaggccaagtggtcagcgtcaaaacaacgcagaaatcgcaatcagcacctttaccatatgatttaacggaactccaacaagtggccaatgcaaagtatggtttatccgcgaaaaagacgttatccttgattcaatcattgtatgaaatccataaagttgttagttatccacggacggattcgaaatatctctcaacagatatcgaagggactttgaaggaacggttgtcggcattagtcaaatttgatccacgtgctaagcaatacttggggcaaggcagtcaggtcaaacaaaaagccgtctttaatgatggcaaagtaacggatcattacgctttaattccaactgaagaacccgttcgtgccgaaaaattatcgacggatgaactacgcatgtatcgcttgattgtagaacgcttcttagggttatttgctgatccatacgtgacagctgttacgaaagccaccgttaagtttggtgatcaaacctttacgtttaagcaaacaaaagtcgtgcaacaaggttggtatgctgccgataaagaggggcaaccaaccgcgacggtcgactggcgagaagggatggtagttcgggctaattttgcggttaaagaacaattgacgacgccccctaagccattgactgaaggaacgttgctcgggaagatggaacactacggattagggacgccagccactcgtgcggaaatcatcgagaaattagttcgtagtgaactcctagaacgacaaggccatgctttagcagtgacgccaaaaggtcagcaacttttgaaattggttaatcagaccttggtttcaccagaactgacaggaaaatgggaacagtcgcttgaagcgattgccaaaggcgaagaaaatccgaaggcgttcatcactgaaatcgagggtgccactaagaccttggtcggtgagattaaaaagagtgagacggaataccgcgattttgcagtgacgaataaaaaatgtccggaatgtgatcatccgttaaaagaacgcaatacgcgtgacggtaaaatttatgtctgcacaaactgtcactatcggcgtcggaaagatccgaaggtttccaaccaccgctgcccacaatgtcacaagaaaatggtgattattgaagggcaaggcggcgcatacttccggtgtcttaatgatgggacgaccgaaaagatgctcgacaagaaagatcgtaagaagaaaatctctaaacatgaagaacgccgcttgattcaaaaagtgaaccaagaagatgaaccagcggcaagtccattagccgctgcattgcgtaaggcaatggaaaaataagctagcaaaagaggtagcaactagaattattctggttgctacctctttttttgttgtttagaaaagttgtttgacttgttgtttggtgcggtcaacgatattctgaccgtctttgacttgcatgctagcatctaagtgagaacgaccagtcatgtaatcgaatgcgacgccaggttcaacattccagacgtaatcgttgaaattcagcgtgccatctgttgaaatggcttgaacccagtaaccgcgcggcatcagttcattaccccgaaaaacggtcgtgactttgtaaatcacttttttgtttgcttcgagcgcagtgcggactttttcttcagaaatctgcatcgttttttgattactgtacgcgctttgggtggcgaggttaagtagattatctaaactgcctggttgaccagcttgaaagttaccattctgatcaaaattaaaagtgagtgtataagcaatcaagtggccacgattttgcggtgtgattcggcggccattgacaatcaggggttgattatgccaacccgttggattccaaatttggcgcgtccggccttctgatttgcccagattccgctttgataagtaagctgtgacgctagttgttcggttaagctggtcgagttgcccatagacgattttttcaccttgccaatccgttgctgttaattggctttgatcgttattaattggtagataggccgcagatccgcttttaaaatcttgatcagcgatggcttgataatcaggactgactgggggtgtttgtttagctggttgctcagtagcaactgtagtagggaacacattttgtaagacattgttgcgaccaccgagataactgactgccaagatagcaatggttaagatggttcgtctaatttttttcgttttcaaaagagatactcctattaatgaaaattgatttgagacaagataaaaacccacgagatgaattgatcatcggtgggctgaaggtattattttgaactattccgtagtgtcagcgtcgtgccaatcgtaatgacttgggggataatttcgctagcggcgagttgtttaaccaataactcggcagctgactggcccatttgttcagtataaactttaacggaacttaaagttgggaacgtgtattggcaaattgaggtatcgttgaaactaatcaggctgagttgttcagggactttgatgcctgattcatgtaaggcgcgtaaagcgccgactgccattgcatcattggcgatgaagagggcttctggtaaatcggaactttggtcttgtaataattgcatcatgagttggtaacctgattcgggtgtaaagtcaccggttaaaatccaatcggggtgatagtttttttgagctttgagtaacgtcttaaaatgaataaaacggggatccagtcccaatttagtattatcagcagtgctctcttgaccagttaacataccaattttagttaagccagcggttgtaaaatggtctattacggatttaattggtgttttgaagtcggtcatcacacagctgacttcataatcgagcgtgttcatgtcgacgaagacgaggttgtggttgagttttttgaggcgcttaatctgcgcagggctgtacttaccaattaccacagcacccgtagcatcatggagcgtatcaaatggatcgttttgaaagaagcgtgttacgtcataaccaagttctttgagtttcttttcaacgccaagtcggatggagaggtagtatagatcttccaattcttctttagcggtataccattcgacaatcgcaatgcgtccgcgttgctggttcattttgcgcgtgtttttacgatagtttaaactttcggcggcttcgaaaatccgttgccgggtctcatcgccaaccgaaagtgtttgatcataatttaggacccgcgaaacggttgcattcgaaacgttagcgagttgagcaatatctttgatcgttgccaaggtgcacccctcaattcaatgtttactattacttagtttagcataaccaatgaaaagaaagcgatagttaacaaaaaagattgattttttagtaaatgtttagtaaaatgaaagcgattaataaaggaggaatttactatgaacatgacagaattaaataccgcattcgaaaacgcattccacaaagcaccagaagcgagctacttcgcaccaggtcggattaacttgattggtgaacatactgattacaacggcgggcatgttttcccaaccgcgatcacattgggcacatatgcagtcgttgctaaacgtgatgaccaaacaatcaatttattatctgggaactttgaagatgcgggtgtcatttcatttgacctcagtgatttatcttatcaaaaagcccacaactgggcgaactatccaaaagggatgattgtttaccttcaagaacaaggttacacaatcgacagtggtttggacatttatttaaaaggcaatattccaaacggcgctggcttatcatcatccgcatcaattgaattattaatgggtgtgattctagaagaccaattcaatttagaaattgaccgtgtcgaccttgttaaaaccggtgtcatggttgaaaataaatttatcggcgttaactcaggcatcatggatcaatttgccgttggaatgggcaaagccaaccatgccatcttactagacacgaacacattggattacgatttagtcccaattgatttgcaagacaacgtgattattatcatgaacactaataaacgccgtgaattggccgattcaaaatataatgaacgtcgcagtgaatgtgaaaaggccttagccattttacaaacgaagaatgatattcaatcattgggcgatttagataacgaaacctttgatttacaaacatacatgctacaagatgaaaacttgttgaaacgtgcacgccatgcggtttctgaaaaccaacggacaatgaaggcccgtgaagccctgaataacaacgaccttgaacgtttcggcaaattagttaatgcgtcacacgtgtcattgcaatttgattatgaagtgactgggatcgaattagacacactcgttcaaaccgcttggcaacaaccaggggtcttaggcgcccggatgactggtgcgggctttgggggttgtgcgattgcaattgttgctaaagaccaagttgataactttgaaacgaacgttgctaaagtttatacagacaagattgggtatgcgccaagtttctacgtggcagaaattgccgatggcgctaaaaaattaggttaatcagtcaactgaagaggagaatgataagatgacagttttagtattaggtggcgccggctacatcggctcacacaccgttgatcaattaattcaacgcggcacggatgtcgccgttgtcgacagtctcgtcaccggccatcaagccgccatcaattcacaagcgcgcttttaccaaggcgatattcgcgacaaagatttcatgcgcagcgtcttccaacaagaaaaagtcagcggtgtgattcatttcgccgctttctcaatcgtgcccgaatcgatgcaagcaccacttaaatacttcgacaacaacacatacggcatgactgccttactcgaagtgatgaatgaattcgacgtcaaacacatcgtcttctcatcaacagcggccacttatggggaaccgaaatcaatccccattaaggaatccgacccacaagtcccaaccaacccgtatggtgaaagtaaattaatgatggaaacgatgatgaaatgggctgacagagcttacggcattaaattcgttgcattacggtacttcaatgtcgctggtgccaaaccagatggttcaatcggagaagatcatcacccagaaacccacttgttgccaatcgtgttacaagtggctgctggcaaacgcgaacaactttccatctttggtgatgactatgatacaccagatggcactaacgtccgcgactatgtccacgtgttagacttagccgacgcccatattttggccctcggttacctcgaagaaggccatgatagtaacgcctttaacttaggctcatcaactggtttttcaaatatggaaattgtcgaagccgctcgcaaagtgactggcaaggcaattcctgtgacaatggcaccgcgtcgtgctggtgatccaagtactttgattgccgcaagtgataaagcacgcgaagtcttgggttggacaccacagtatgacaatatggaagccattattgaaactgcctggaattggcatttaaatcacccagcaggatacgcagatcggtagaggaaagtatatgcaagcaagagaattgattcaaacatttattgaaaaagtgattacctttcaagacacactttatacagcagaagaccaacagtacttatttaatctcgtcttagaccttgttggggaagaggacagtaacgttgcggtgagtgatcaaagtctcatcggattaaaggacgcgttgttgcgtcttgcagttgcgaatagccggattgaggatttagcggcagaacaagacattttaggggcgaagttgatggatttggtgacgccattaccaagtgcggtgaaccgtcatttttggcatcaatacgagagtgagccccaacaagcacttgccgacttttatgaattaagtcgggccaacgactatgttaaagtggccgcaatcgcgaaaaatatcgcttatcaagtgccgacgcaatatggcgacttagaaatcacaattaatttatcgaagccggaaaaggatccgaaacaaattgcgttagccaaaacgatgaaacaaacgggctaccccaagtgtcagttatgtctggaaaatgaaggatatacggggcgtttagatttcccagcacggcgtaatcatcgcatcattcgtttcgagttggcgggtcagacgtgggggttccaatattcaccatatgcttactttaacgagcattcgattttcctcgatggtcaacacgaaccaatggtgattaatgaaacaaccttcaaaaatttattacagattgtgaagcagttccccggctatttcgctgggagtaacgctgatttaccgattgtcggtggttcgatcttaacccatgaacattatcaaggggggcgtcacgattttccaatggctaaggcgccaatcgagacaccactacattttaacgggtataatgatattcaggcgggaattgtgaagtggccaatgtcagtcattcgtttgacgagtgcgaatgcaacgcatttggaaacactcgctgcacaaattttaaccagttggcaaaattacagcgatccaagtgtccaaatcttagcccattcagaagatggcacaccacatcatacgattacgccgattgcgcggatgcgagacggtcaattcgaaattgatttggtactacgcgacaatcaaacgtctgcagaacatccggatgggatttatcatccacatgcagatgtgcaacatatcaaaaaagaaaatattggtttaattgaagtgatgggcttggcgattttgccgccacgtctcaaagatgaaatggcagaagttgaacactatctctgtgatcaaccgaaccagatggccgcttaccatcaagaatgggcagatacgattaaagccgctaacacatcgattacatcagataacgtaacggaattagtgcggactgaagtcggcaaagtgttcatgcgcgttctagaagacgctggtgttttcaaacgcaacgaacaaggtcaggcagcatttatcaaatttacacaacatgtttaacctgtaaggagggacattcatgaagtattggcgagaagcatttggtgaaataaatggtcaaacggtttggcagtattggctagagaatcgtcaggggtatcaattagccgtgacagaatacggcgcaacgattactcacttggtgatgccggatcaaagtggtcagatggccaatgttgtgattggctatgacaccctagcggattttgtaaagcaacaagcttattttggtgcgacagtgggacgcgtagctggccgcatcggtcaaggtgcttttacactcgatggtcatgattatcaagcaccgattaataatggcgccaacacgaatcatggtggccccaatagttttgaatcgcaaatctggcaatcatcagtggttgaaaaagatgatgcgattagtgttgttttcacgttaacgagtccagatggtgaaaatggattccctggtaatttagcggtgaccacgacgtatacgctaaatgaggccgatgaatggctaattgactatcaagcaacgactgataaaaccacgttgtttaacccaacatgccatgtctatctgaatttgacgggggactttgatcaatttgttggccaacacacattgcaaatcgatagtgaccgttttggtgccattcaaccagacggcttaccaaccggggaattagtcccagttgcgggctctgcctttgatttacgtcaaccgcgagctttgcaagccgcttttgatagtgaaaatacgcaaactaaattggtcggtggttttgatcatccattcctgttgaatcaaacgccgggtaaagcggatgcgattttacgcgatcccgaaagtggccgctcgatcacaattgatacagaagggaatgcaatcgttatttataccgccaatggcttcggggacgaaccaaacttaacaaatcaggcaattcaaccccaccaagcagtggcgattgaagcccaaatgatgccagatgccatccatcataccgagtttggtaatattgttttgcatcctggtgaacaatatcaacggcggacccgatataaactcaattaatttattttacgcttgcatgcggttacaaaatcgcgtacaattgacttgtttagatgaccgattctggtggctagataataattgtgtatttaaaaggagtaacatcatggaaaaaggaacagtaaaatggtttaacaatgaaaaaggtttcggctttatctcagcagaaggtcaagacgatatctttgtacatttcagtgcaatccaagacgaaggcttcaagtcgttagaagaaggccaagcggtcgaattcgacatcgttgaaggtacacgtggaccacaagctgcgaatgttgtaaaactttaatttaaaggaattaaatacgactattctaatttgattagatttaaattagaataaaatcatccaagtttataaaaaaatagcccaaaagtgttgactttgtttatcgtgtgaactatgataagcacataagttaatagagcgattgaaaaacgcagtagaattagtaaccactattacagagagtcgggatttggtgagacctgatatatgtttctaagtcgaattacacttttcgtttcattaaatcgtacgttggatttacgttaaaatctagagtgatattttgaaagtgcactttcaaaatataacacgggtggtaccgcgaaaaaatgatatttcgtcccagtagtctttattttattaaagattgctgggacttttttatttaggaggaaattttgatgagaaaaaatattattgatgaattaacatggcgggatgccattaaccaacaaacagatgctgaaggcttacgtgaattagttgaaaataacaaaatttctttatactgtggtgctgatccaactggcgatagtttgcatatcggccatttgattccattcatgatgatgaaacgattccaattagctggccatcatccatacatcctaattggtggtgggacaggctctattggtgatcctagtggtcgtaactcagaacggcagttacaaacaatggaaaaggttcaaaaaaatgtcgaagctttatcaagccaaatgcggaaattatttggtaaagatgccaacgtcacgtttgttaataattacgattggttgtcaaaaatttcattattggactttttaagagactacggtaaaaactttaatatcaatacaatgctagctaaagacattgttgctagtcgtttggaagtcgggatttcatttactgaattcacataccaaattctacaatcaattgatttcaaacacttgcatgatgaacataacatccaactgcaaattggtggggctgatcaatggggcaacattacttctgggattgatatgattcacaaacttgaaggtagtgacgaaccagtttacggcttaacgattccattaatgttaaaagctgatggtactaagtttggtaagacagcaggcggcgcaatctggcttgaccctgaaaagacctcaccatacgaattctaccaattctgggtaaatcaagatgaccgcgatgttgttaaatacctgaaattcttcacattcttggaagaagatgaaattgaagaattagcacaaaaagttgcaactgaacctgaaaaacgtgaagcgcaaaaacggttagcacaagaagtgacacgttttgtgcatgggcaagaagcattggatgaagcagaacacattactgaattactttttgaaggtaatatcaaagctttagatgttgttgaagcagaacaagcttttggcaaagcaccatcagttgaaattagtcaagaagcaaagaacattgtcgacttcttagtggatacggggattgaaccttcaaaacgtcaagcacgtgaagatgttcaaaatggcgccatcacaattaatggtgatcgaatccaagaaactgatgcaatgattgatccaatgaccagctttgatggtaagttcgtgattatccgccgtgggaagaagaattacttcttagcacgtgttaccgactagtgacgttccaaaaactaaatgaaggcttttgtatctatactaaatgttactgagttcttcgtgaatgtagagcattatagtataaccccaaaaatataacagcaagagtagccgtcaaacgcgttttgacggctatttttcgttttttcaaaaaatgtaagcgttattatggtttgctttttcttacaaggggcgtattgtattgattggggttatactatatctacatttaggaggattttttgttatgagtaacactagttttagtgcaaaagatacagatttatctgctctatttatcggtgataaagctgagaatggtcaactgtataaggatttgttaggtaagttggttgacgaacatcttggatggcgtcaaaactatatgccacaagacaaaccaatgatttcagctgaacaacaaacatcacctgagttccgaggaacagtcaacaatatgaaagacgttttagatgaactttcatcacgtttacgttcacaatcagttccttggcataatgctggccgttactggggacatatgaactcagaaacgttaatgccagctattttggcatataactatgcaatgttatggaatggtaataacgttgcttatgaatcatcacccgcaacttcacaaatggaagaagaagttggtttggaatttgcaacattgatgggttacacaaatggctggggccacattgtggctgatggctcattagctaacttggaagggttatggtatgcacgtaatatcaaatcacttccatttgcaatgaaggctgttgatccaacgattgtcgctggtaagacagactgggaattatcaaatatgtcaactaaagaaattatggatttagttgaagctaacggcgacaagatcgatgaaatcaaagctaaatcagctcgtggtggtaaagaccttgacaaattaggcaaatggttagtaccacaaacaaaacattattcatggttaaaagccgctgatattatcggtatcggtttggatcaagttattcctgtaccagttgattcaaactaccggatggatattaatgaattagaaaagattattcgtgaattagcaagcacagaaacaccaattcttggggttgtcggcgttgttggctcaactgaagaaggtgctgttgatggcatcaacgaaattgctgaattacgtaacaaacttgttaaagaaggcatctatttctacttccatattgatgctgcttacggtggttatggtcgtgctatcttacttgatgaagataacaaattaattccatacaaagacctacaaagcaaatttgctgaatacaatgtcttcactgaagaagaaaaccttgtttcagaacatacttacaatgcatatgctgcattcccagaagcagaatcagttacaattgatccacataagatgggttacattccttattcagctggtgggattgccatccaagatatgcgcatgcgcgacgtgatttcatacttcgcgacatacgtctttgaaaaaggtgcagatattcctgcattattgggtgcatatattcttgaaggttcaaaagctggcgcaactgctgcatcagtatgggctgctcataagacattaccactgaacgttactggctatggtaagttagtcggggcttcaatcgaaggtgctcgtcgtttctacaacttcttaagtggtctagaatttaaagttggcgacaagacaattgaagttcatcctttaacagatcctgacttcaacatggttgactatgtcttccaagaaaagggcaataacaaccttgtggaaatgaacgaattaaaccatgaattctacaaccaagcttcatatgtaactggtagcatctatggtaacgaatacctaacatcacatactgactttgctattccagattatggtaacagcccattcaagtttgttaataacttaggcgttactgaagaaggttggaaagaagctggtaaagtaacggttcttcgggccgctgttatgacaccatatatgaacaaagcagaaaactttgattactttgctcctaagatcaaacaagctatgcaagaaaaattagaagcaatttacgaagatcgtaaataattctaagtaattgtttagtaaaaagaaaagccgcgcaagcggctttcttattgtgagatgaaatcggaggaaaagtaaaaatggaaaataaacaagttaataaaattgctttaggaacctttattggtttaacaatggccttgtgtgcaactgttcgtagtattccgacgttagctgcaacaggttgggctcaaatcagttattcaatctttgcagtattattcttcgcactaccaatcgctttgattgctggtgagttagggactgcaatgcctgaagaaggtggcccacaactttggattaaaacagcgttaagtagtaaattaggtttcgttgcagcatggttactttgggtacaaatgttcccagggatggtaatggttgcttcaacaatcggacctttattgggtaactcatttggtaatccaactttagggaataaccactggtttgttcttggttgtatccttgtgttctactggattatcacattattaaacttaaaatatgatatggctaaagtcggcggcaatatcggtgtttggttaggtgtttatattccaatcgttattatggcggttatggggattgctgcattaatcaaaaacggcatcatgcctggcggtacattgggtcacttctcaatgggcaaattaattccaactaaagatggtttatcatcattgaaatatatggctggtatctcattcatctttactgggattgaaatgtcatctgtctttattccacgtttacacaacccatcaaaaacctttactaaagggattttcgtttcattaattggcttagttgtcttgaacttagtaaacgcaatgttagttgctaacgttgtaccaatgggtaaaatggaactttcaaatattacacaaccaatcttaatttattgtcaaattcttggttggccaacaatgatcgccaacatcttcagtttcatggtcttcatgggtgtgttattacaattatcagcttgggtaacaggtccttcaaagacaatcatccaagttgctcgtgatggttatttaccagcaaaattaggtttccacaaacaaaaccaatatggcgtttcaaaaaatgttgttttaacacaaacaatcgccatttcattatttgctttattatatggtttcatgaaagatgtcaacggcgtattcttaacgttaacaaatgcaacaacaatcttgtatgcaattgtttacttattaatcgcagtggctgtcttgaaactacgtaaagatcaaccagacttagaccgtccgtaccgcattggtaaaaaagggaacggtcttgcatggactgtttcaattgctttgattttagggattgcaattatcgtctttgcaaccttattcacaacaagcttgtcacaatcattattggttgttatcatttcagttatcttcactatcattccatttattattagtaaatataagaatgatcaatggttaattgacatccaaaaagatatgcaacaaaaatagtttcaaaaaaaatggtcagctgttaaaagtctgaccgtttttgatagttttaacaattgaataagttagagggtgttcaaatgacacaagaaaaaaagaaacatacaacgagtttactggaatcgattgtgattttggtcgggatgttagcttgtcttggtattttaattattaaatacaagatgacaccgcatattccaatcttaatggtttttacagtgctcttattttatggcaagtttcgtggttattcttgggatgaaattcatgatggcatagttgaagggattaaaccggggattattccgattattatctttttactgattggcgtgctcgtggcaacttggattgctagcgggaccattccaacgattatgtattatgggtttaagatggtatcggttaaattctttattccaactattttcctattgtgtgctgtgattgggattaccgtgggtagttcgtttacaaccatttcaacaatggggattgcctttttaggaattgggcatatattggggttttcaaccgcattgacggtgggcgccattgtatcaggtgcgtttttagggaataatctctcacctttgtcggataccactaatttagcatcagggattgctgggattgatgtttatgatcacattaaaagtatggcagagacagcactgccagcagcgctaatctcgctcgtcttttatgtggtggtcggtagtagctcgaaatcagctaatatggccggcattcaacaaatagcagatgtattgatgacgcactttgatatctcattttgggcgattttacccgtcatcatcttgtttatttttgcgtggctaaaagtacctgcaattccgtcgttattaaccagttcatttagtgctttgtttatcacactttttagaagtaaacagcattacagtctaaaagtattgtgtgacatgctaatgaatgggtttgttgcaaagacgggtaatcgtcaaatgaatgtgctactttcaagaggtgggatggcaagtatgttaaattcagctgccttgattatccttgctttatcacttggcggcttactgattaagtatcaagtggttgaagtgctgattacaaatattcagcagttcgttaacacacctgggaagctgattatgatgaccattgtgagtgcgactgggattaacttcttggttggtgaacaatatttgtcagttattctttcaggagaaacgttcaaatcagcatatgataaattgccattagatcgtaagtatttaagtcgaacgctttctgccggtggttctgcagtcaacgccttagtaccatggggcgtcagtgggatcttcatagctggggctctcggggttaatccaattgactatgtaccgtttgcgacttattcatttattgaaccaattatcagcattgtgattggttttaccgttgttacttggcgctatagaaaaaatcaagcgaagtaatggaaacttcctcaatcaggaattatttttgattgaggaagttttttatttttaactaaaaccacggtataatagacggagtaaacttaaaagaaagaaagtgactcacagatggcattaagttatgcggataatccgcaggttcaaaaaaatcgttggcgaatattgacggctgtcggactatttaccttcatgtcgacgcttgatggcagtatcgttaatattgcacttccagtcatgagccgtgatttaaagattccgatgaatcaagcggaatggattgtgtcgatttatctgattatgatttgtgccttattattattattcggtaaaattggcgatgcttttggaaaggtcaaagtgtttaaaattggaaccttcttattcgtgattggttccttgttgtgtggctttaacggcggcttaccattgttattaggtgcacgcgttgttcaggctttaggggcatcaatgacgatgagcaataataatgggattattaccgaggttttcccactgaaagagcgtgggcgagcgttggggttaaccggatcattcgttgcgttaggtagtattgccgggcccgggattggtgggctaatcttagcgcattttagttggggctatattttctggattaacgtgccaattggaattttaaccattatttttgggcattttattttaccgaaggatattgttaaaacacatgaaaaaattgactatgcgggggttgccagttttgcagttttaattgttagtttattcctcggtattttcatcggccaacaaattggattcacctcacccattattttaacggcctttgtcgttgccttaattagtgctggcatctttgtttggattgaacaacatgtagaacagccattattatcgtttagattgtttaaaaatatcgattttagtttaagtttactctgtgcgttcttaattttcatcgttaacttcttcttcaatgtgatttcaccattctatctggaaaatgcgttgggcttagcgcctaatcttgccggttacagtttaatgattttcccaattgttcaagtggtggtcgcaccgattgccgggagtatctcggatcgaattgggccaggaatgttaacctttatcgggttagtgttgatttcgatcagtcaggtcggttatatgttgatgaatctgcaaacaccgatctggttattcatgttcttcgtcggcttagttgggcttgggaatgggattttccaagcaccgaataacacgattgtcatgagttccgtcggtgttgaagatctggggattgctggtgggattaacgccctcgcacgaaatctcgggatggtcttcgggatttcattatcgacgacggttttatatgccgcaatgagtcgcaattacgggcaaaaagtgacggggtatattccgagtcacgcgaatgtgttcatcgctgggatgcatgatgcctttatggttgcgctagtgatttgtttaatcgcaacggctctaaccggttggcggatgttgaaacatcgcaaaatagcttaactattcaaaaatagcgccgctcatcaaaaaagatgggcggcgctatttttgtgaatttaattaacttcttttggtccgctgttagcagtggtttgaccttgggtatagtccaataagtgttcgcgcagatcattttccatgtggttgagttctttttcagccacttgtcgtttttcgcggccttcttgttgaatcttgagagtttcttgtaaggtttcaacaagatcattttgtgttttctgtaaggtttcgatatcaacgacgccgcgttcattctctttggcggtttcgattgaagacatcttcaacatcgcactatttttcttcaagaggtcattggtcgtttcggatacttgtcgttgtgcagtgaccgcatctttttgacggagcagggtgagggcgatggcaacttggtttttccagagtggaatcgccgtgttaatggaagcttgaatcttttcagctaacgcttggttggtattttgaatcaagcgaatctgcggcgcttgttgaagtgtgatttgccgcgctaattcaaggtcataagtccgtttttccaagcgattcttgaattgattgagatcgttgacttcttgcacaaccatttgattatcgtcatttttagcacgttccatggcttctggaatcgtcgttgtttctaattcttgaatcttcaactgaccagcagcaatataaatattgagtgcatcgaagtaggctttattcttcgcatacaacgtttcaagcgtctcattgtcgcgcattaatgcatttttttctttgtccaatttaacagcaatcccatcaatttgggcgccaattttttgatatttcgcagtgatttcatagaccgacttcttaatcttgccaaacatccgcttgaaaacgttgctgtcttcggcgcgtaattcgtcaggattggcttcgtttaaacggtacatcaatgacgttaatgcgtcaccaatttcgcctgtttcttggctttggacttggttgagcattgtttgggagaaagcgccgagtttcttttgggcttgagcgccgtaattcaagacggctttttggtcgttgacgtccagttgttgtgccaattgttcggcctgtgcttgttgttcaggggagagcttattgataattgaggcctctgcttggggggctgcttcctcagtgacaactggcgcactttggtcgaaaggatcttttaataaatcattcattaaatcgttcgttggattgggcgtttcagacattagtcttcctccttgtgatctggggtgatttgttgttgagcgacggagacttctgtgtctaagtcatcgacgtcttcggccacgaaatccgtgtagtcttgttgaatctgttgactaagcgcatcaattgccgcagccgatttatctaaaacgagataggtatcggctgtcttgacttcatgatggttaatttcgatgtatttgctagtcagttcattgattgatggtaagtgccggtataaaaagtcgccagcattgtgaagccgctttggatctttcacaatcgcacgaaaaagcgattggctgaccttggttgtatcgtgatttaaatcgattgcccgtaatttaggaagagcttgcatgttggttgcaagtaccttaatttgcgcttcggcttgttgcatcgtttgtctgaaaaagtcaatttcgtcatcactcatgccagcatcttggtagtgtttcagcatttgtggtgaaatatgctgattttttttatattctggttgtcgtttaagccgtttgaggctgattgtaacgtagatcagacctaataataaaccaaagctgaaccagatgaaattatcccaatcaccataaatatcaaagcatgttgccaaaattgggattgagacaagtgtaatgagcatgcctgtgcaccaaatcgttatttttttaaacataattgtcagctcctgatttaattgatgccttcattctaacaggaattaaggtaaaagagtatccgcctaaggatggatttttaattcggtcgtgaacctgaatttagcattgacgatggcggacgattttaaatgcgcgtataatagcgattaaacgataaaggtggcattagcagatggagtatacagaaaaggtcctctcggaagaaacattattcaaaggccagatcattgatcttgccgttcaacaagtggcactgccaaatggacaaaccgcaagtcgcgagattgtctatcatcatggggcggttggcattattccgattacggcggataaccgcatccttttagtgcgacaatggcgcgcccccatgcaacgtgaaacgttagaaattcctgctggaaagattgatccaggtgaaaaggacttagatcaggtcgcactacgtgaattgaatgaagaaacgggtttgacgacgcaaaagctcgtgcacgtgacggatttcttttcatcacccggtttttcaaatgaattaatgactttatactacactgatacactaacgccggtcacgcataagcgctcgctagatgacgatgagttcttgaacgtcgaaaagttgacgttagaagaagcacaagcagtcgttgcagatggtttaatctgtgatgccaaaacgattatggcgttgtattactggcaattacaagcaaaataggagcggtagaaatgacgaatgaacctaagacgcgcgaagaatatcgacaacaaaaagaggctgaagaagccgcctttaaacagcgcgatcaagagcgcctcaggacagaacgtgaatatgcacgtgaacaacaaaaagaagcccttaaagcggtgactgaagacgaaccagaaacagcaacgcgtcggactaagaaagtcgatccaccagcggttaaacgaatgaagaaacggttgaattgggcgattgggattacctttggcttaattattatcgtttacttgattctttttttcctatagaatggtaaagttaatgtttttttagaatggagagaattagtatgaaaattagtgtcatttgcgccatggaagaagaaattcggacgcttttaacaaaattagaagatgtgcaacaacacacggttgctggcaatatcttttataaaggtcaattgtacggtcatgaagtgacgttggttgaatcaggaattggtaaagtgcaagctgggatgacgacggcgattttattagccgaagaaaaaccagatgttgtgattaataccggttcagctggtgggattggtgaaggccttcatatcggcgacgtcgtgatttcaagcgaagtcgcttatcacgatgcagaagcaactgcctttggttacttaccaggtcaattaccacaacaaccccaacgatttgaaagtgatgctaagattgttcaacaaatcgaagcggcggctaaagcggttgacctacaaccacgtgttggtttaattgtcaccggtgatcaatttgttgcgagccaagataaaatcaaggcaatcaaagaaatttaccccgaagcgctctcttgtgaaatggaaggcgctgcaattggtcaagttgcaacgcaattcaagattccattcgttgtcattcgcgcaatgagcgatgccggcgacgaagaagccggcgtaacgtttgacgaattcatcgtagaagcaggccaaaaatcagcagcaatgttgcttaacttcttgaagaatattaaataaaatgggtgcgttcaagttggttcaacttttgagcattagcacagggaagcgaattagcgacgcagtcgatgatttgataagtgcagcaaagcgcaggaagctgttgatgaaagcacgttaagaaaataagtgtgttcaaactggttatgttctgaggattagcaaaattagacgaataagcgacgcagtcgatgatttgataagtgtagcaaagcgtaggaacatggtttgaaaagcacgttaaaggagtccacccatggaaaaattctgtcaaagttgtggtatgccactgactgcacaaaaccaaggtagtgaacaagatggcactaagtcaaatcagtattgccaactgtgttacgttgatggtcagtggacagaaccaacaatcacttttgaacagatgcttgaaaaagggattgctgggattcgtgccgaccaaacaaccggtaagatgaaacaatggttcctaattaaaagctatccgatgatgcttaaaaagatgcgtcggtgggcataaaatatcaaaagaaacttatcctaatgggtaagtttctttttttggttaaatggttaaattctgctaaactaacaacaacgttatgaatggaagagggaatgtcaatgacaccagaggtgcagcggtattggcaacaattcacggaacagcaacagttatcacctaatttacaaccaacggagatttattcatttgggaatacagaacaaatggccaatgaattgtcacgattggtggtaagcggtcaaaaaacggccaccacttctgcaattgagttgtatgaacccgatgagcatgtcccacaagtgggggattataatgttattttagatggacgagaccggccggttgcaattacgaaaacgataatgtgcacgattgttaagtatgatcaagtcgacgctgaacatgcttttttagaaggtgagggcgatcggacgcttgattattggcgttcagctcacgagcctttttttaaagctgaatatgcagaggcagggcaggtgattacgccgacaattgcctgtttatgtgagcgttttgaagtggtaacggggaggcgtgaattaagatgattcctacacgattgtcagaaggtgatgagattcgggtcatccgcgcctagtaatagtttgcaaagtgttggcggatatgtggctaatcaaccggcgaatgatcgattgagtgcacttggttatcaggtgacgtttgggcagcatgtcttggtaatggaccaattcaattctagtccaattgaagcgcggattgccgatttgcacgctgctttcatagatgacaatgtcaaagcgattttagcggtgactggtgggtataacagcaatgagctacttccctatatcgattttgatttgattgcaagccatcctaaaataatctgcggttattccgattttagtgctttggcaaatgcgatcacagctgagacaggtttagtgacgtattatggaccgtcctatatttcgtttaaattagtagatcaattgggcgattatcaggtgcgtaattggcaaaaagtcatgacgcaagatgctggaccaattcgattgacggcttccaaagagtggtcgagtgatgcgtggtacttaccgaatgcagcgcgggattaccagcctaatcattggcagagttatacgtctggctgtgtaactgggacgttagtgggcggtaatttaaatacactttatacattacaagggactccctaccaaccagattacaataatcaggttttgttaattgagtgctcagatgggtcagatcgatttgatttttcacgcaatttagcggcgttattacagagtatggaacaaccaaaggccctgattataggacgtattccaatcgatgtcgcgctgagtgaggcggatttaaccgctattttgaataagtttccgattttgaagacaatccccgttttgtataacgttaatgttggtcatacccagccgattctaacattaccgattggacagtcaatcacggtcaatgccacagaaggccggttacaaatcgaacagaagtagcaaaaagaacgaccaactatattagttggccgttctttttagagtagtgctaaagtttgttgtagttctggttcttgttcgagttttacgagtggtaagtcatgggtcacttgatggtcttcattaaagacgaccacccgtttagcgacttgtttgacttgagccaggttgtggcttgcaattaaaatccctttgccggcttgattgagttgttggagcaagtggataatcagcgtttggtaggcggctgataggccgttgaatggttcatcgagcacaatcagttcaggattcatcgttaaaacactgcccaaagcgacaagttttttttcgccacctgaaagttgataaggcacgcgatcagctaagtgttcgatttgtaacaacgcgaggcaatcgtcaacgcgggtttgcacttcatctggggctaagcccatctgttctggaccaaaagcgagttcggcgcgcaccgtttcgttaaataattgaacgtcactattttggaacacaaagccgattgcgcggtggagggcagtcgcctgtgtaggctttttgaggaagcgggcatcgacaagttggtctttaaaataatattggcctgcgcttggctgaatcaaaccgttaattaatttaaacagcgtcgattttccggaaccattaggccccataaacgcgacggcctcgcctgcttgaatggttagtgagatgtcgttaagactgtcggtttgtgtataggcgtagtgaatgtgttgtaaattcagcatctgattacctccgaatgaaacagaataggcaaaatagccctagatcccagctgattaagcgccagtcgtaacgattcactgttagcggcgtccgccgggtgacttgtccggtgtagccccggagaatcatcgcatcgtataacgcggcaatgtagttgcgggaacttaagtagaggcggccaatcagtgaaccgactaaattttgccgttggtggcttttaccagttgagcgtagccgaattgcccagagggattcttgtaaaaattgggcgagcaagtggctgtatttcagactaatttcgagtgtcaaaatgagcagactggggagtcttaattgacgtaaagcaacaataaaagcgggccaagtgatcgtctcgagaaaaaaagcaatattcaataacatgatttcagtccgtacgataaataaaagcgttgtggcgacttggccgagccaaaaattcggtagaattaataaaatcgcaatgatactgatatcaccgacgcgtttaaaaagcggccataaatgctggcttggtaagcggcaaattcgaattaacgtcaataaaccaatcaaccaaattaaaagtagactatgggttaacacgagaatgatgagtgtcaccaataaactaatcagttgaataccaggcgtttgatgggcggttaaaggttgaggttttgtttgattaaagcgccgcagcaaacgatcactaaagcgcaaattttgaattaaaaaacggtcgaattgcgcgaccgttttgggcgtagcttccgttgtttgaagccaagttggtaatttaggattgggttgaataatgattcatcaccagttttccgataagataaaaaacaatgacggctgttaccgctgataagatgtagccaagtgatagtggaacgccagcaactgtgtagtcactaaagagggcattaaagtttaagccatgggccataccacttggtagactgtgacctaggtgatcatgtttgagttgtgcaacgagttcacttgcgctccattcgccccaagcagtaccgctagctaataagccaatcggcgataagatagtcaataggccgatgaaactgtaaagcgcgtgatgtaagcgacggctggtttgtggatcaactgtttgacgtggtgcaacgaacagttcgttaggtgcaacccggcaaatgaattgataaacggcgagggtaaagccggcttcaacccaaccagcgactaataaatgagcgaacaacatggctggaattgcaatgtgtaacggataaggagcatacaagggttggccagctgcgttatgcgcaacgagcggttgcagaccaagttcaataccggccattaatgcggcggcattaattccgagatatgcgccaactacgactcccactttgggatggtgtgctttttggaatagtcgatagagaccatagccgacaaatggcatggtaatggccatgttgaaaatattggccccgagtgcgagaatcccaccatcaccaaataaaaaggcctgcatgatgagtgcaatcgttaccgctagactagcggcgtacggcccaatgagaatcgctaatagggttgcaccaacagcatgggcggttgtcccacctggaattggcacgttaaacatcatcatcagaaacgatagcgaagcggaaatccctaacatgggtaccgtttcttttttttcgcttacttggtatttgactttcttgagtgccaagccaatgactggaatagcggccgctgcaagcacggcacacgtttggggacttaaataattatctggaatatgcatacataaaaacctccgctgatttgttctcgactattaaggatacgcgtctcatagccgttttcaatcacgaatcatgtttacatatgttaacaaatcgctaattggcgatattatcaagcaagtaactgacatctttgattaagaatttatgctcggtggtttcaatcacgccgtcttttttgagttggttgagcatgcgattgacactactgcgcgagctaattccgcagaagccggcaatgtcttcgtttgtaacgacgaagtcaatcaggatgccatcgcggcgtttcttaccaaagagatcaattaagctgtataagaaggcacacagcccgccgtttttaccgttcattaccattttttgcaagcgataaatattctcggataattttttgcggtagtaatttttaacgtaattctgtaactcgggggtggcattcacgtagttccagaaggtcacacggtcaatctgatagaaagttgcttcatctgtttcaacgcgaacgttaaacggttgatccgtatattttgaaatttcatcccgtaaaagtgaaatgacatccggctgggtaatgtaagagagattgaattcacgaccgtcttgtaaaatgatcgagtttttaatcacgccttttttcagaatataagtataccgttcttccaaaccgtggtacgtcaagtatgtgtgcttctttttggtaatcactgggacgtgacgttcctctaaaaagttaattaaaaattcaatgtctgttaaaaccataatgcatctgcctatcctttgtgctgatttgttatatttactaatcattaaataactttaatctaaattatacgtcttgaagactataaagttgttatcatttgttacacctaaaagtaataatgaaatgttgttcataaattataccgcatccttttcagaaaatctgtataattatggacgtagctttaaaaaaacattcaatcagcattgagaaaggaagtcctatagtttggtagccattaaattaccttacgatcaaaaaattatcacggctaatattgcagacgcgaattttgccgggaagcttgtttcacaagctgctacgtatcaaaatccaatgagcgaagccgaaacggttgaaaaatcattggacaatcccattgatagccctaagttagaagagttggctaaaggaaaaaagaatatcgtaattatcagttctgatcatacacgaccagttccttcacatatcatcacgccgattttactaagacggattcgttccgtagcaccagatgcacggattcggattttagttgcgactgggttccatcgaccatcaacgcatgaagaattggttaacaaatatggcgaagaaatcgttgcaaacgaagaaatcgtcatgcatgtttcaaccgatgacagctcagttgtgaaaatcggtcaattgccatcaggtggcgattgcattatcaataaagtcgctgttgaagctgacttattgatttctgaaggcttcattgaatcccatttcttcgctggtttctcaggcgggcggaaatctgttttaccgggtgtggcttcatacaaaacaattatggccaaccactcaggtgaattcatcaattcccactattcaagaaccgggaatttaatgcataacccagtccacaaagatatggtttatgccgctaaacaagctgggcttgaattcatcttgaacgttgttttagatgaagacaagcacatcatcggttcattcgccggtaatttagaaacagcgcacaaaaaaggctgtgacttcgttgaaagtttatcagaagtcgacaagatcgattgtgatatcgccatttcaacaaatggtggctatccacttgatcaaaatatttaccaagccgttaaagggatgactgctgctgaagcaacgaacaaacaaggcggcgtgattatcatggtcgctggtgcacgtgacgggcatggtggtgatgggttctatcacaatattgctgacgttaaggatcctaaagaattcttagaccaagcaatcaatacaccacggcttgaaacggtccctgatcaatggacatcacaaatcttggctcggattctggtccaacatcatgtgattttcgtgtcagatttggttgatccacaattaattacagacatgcatatggaattggcaaccagtttagatgcagcgttagaacgggcctacgagattgaaggggcagacgccaaagtgacagtgatccctgatggtttaggggttattgtgaaataacaatagaaagaatgagtagtttggacacaacaaatgagctacaacagcttttagaagctgttgcaaaccaaaaagtcagtgtgacagaagcaacacagcaactggcacatgcgcagaccattgatgatttaggctttgccaaggttgatttaagccggcaaaagcgcaatggctatccggaagtgatttatggcgccggtaaaacggcggaccaaatcattggcatcattggttcattaaaacgacatgccgaaaatattttatgtacgcgagtttccccagaaaagtacgctgcgattcaagaagcggaaccgacagcaatgtactatgaaatggcgcaatgtgtagtgctgatggttgacccactaccaaccacggatcactatatcgccgttgtcacagcggggacttccgacatggcagtggccgaagaagcggcggtcactgcagaagtatacggtaatcaagttaaacgaatctatgatgttggtgtggcgggcattcatcgcttgtttgaacatttggatgaaattcgtcaagcccaagttgtcatcgtggtcgccggtatggaaggggccttagccagtgtggttggtgggttgatcgaaaaacctttgattgccgtgccaaccagtattggctatggcactaactttggcggactaacagcgctgatgaccatgctcaatagttgtgcgtccgggattaccgtcgtcaatgtcgataacggctttggtgcgggctactcagcaagtatgatcaatcatttaagtgacacggaggatgacaaatgagaactctttatttagacgcattttcaggaattagtggggacatgttcatcggcgctttgctcgatttaggggttgatttcaaacagtttgaaacagaattggctaagttgaatgtccctggctaccacttacatgcagaacggattgctaaaagtagtatttatggcaccgattttgacgtccgtttgccagaagccgtgcacaaggatgaaggttttattgaaacaacaccggcacagcatcaacatccgcatacacatgcagctggccatgcacacacgcatcaacacgcgaatggacacacgcacagccatggggatgacgtccgacatttaaaagacattgaagccatcatcgatcacagtgatttaagcgattatgttaaaacgaacgccaaacaagtttttacagaaattgcgcaatcagaagcggtcgttcatgacctaccattaagtgatgtccatttccatgaagttggggcgcttgattcaatcgtcgatattgttggagcgtttgtcgccctcgaattattggcagttgatcaagtctattcatccgaattaacggatgggagtggctttatcaaagtcgcgcatggcatgatgcccgtgccagtccccgctgtgatgcaaatgcgcgtcggtagtgcgattccaattaaacaaaacccagacttgcagaccgaattgatcacgccaactgggatggggattgtcaagacgattgtcgaccaattctgtccaatcccagacgatcaaacgatcattaaagtcggctatggttttggtaatcgggaaacaccgcaactcaatgcattacgcgtgatgttgtgcgaaaaaaaaaactaagccaacaggtcattgaggaaaagacagatcagatcttagtgttggaggccaacattgatgaccagtcagcagaaagtttagcgccggttttggatttattgatggacaatggggcgctcgatgcctttttcagtccaattcaaatgaagaaaaatcggcccgcaattaagctgacggtcatgattcatccagccgatcaacaagccatgacttatctgatcttaaaacacacagcaactgttggtgtgcgttaccagacgatggggcgcaccattatgccacgtcattttatcactgtagccacgcgcttcggcgatattcgggtcaaaatcgtgaactatgacgatcttgaaaaatatagtccagagttcgacgattgtctggctgccgccaaggcgcatgacgtggcacttaatcaagtttatcttgctgtttatcagagtatgcccgagtcgggtctatcctgatgtagcgcgttaaagctatcaaaatttagatattaaatcgttattatttggaggaatttattcatgattcatcagttattagcagaattcatgggcacagcgctcatgatcattttcggggttggggttcacagtgatgaagtcctcaaaggttcaaagtatcgtggctcaggtcatttatttgccattacaacatggggttttgggattacagtttcattattcattttcggagatgtttcaattaacccagccatggtgttagcacaatgtattttaggcaacgtttcgtgggcaatgtttatcccttactcagttgctgaagtcttgggcggggttgtcggtgcagttatcgtctatatcatgtacgctgatgaatttaaagcatcggaaggcaatgtcgatcctgttgcggttcgtaacatcttctcaacagcacctggtatccggaatttaccacggaacttcttcgttgaatttttcgcaacatttgttttcatttcatcaattatcgctattacacaaattaagacacctgggattgcaccaatcgcagttgggttacttgtttgggcaattgggatggggatgggcggtcctaccggattcgcaatgaaccttgcgcgtgatatgggtcctagaattgctcatgcgcttttaccaattaaaaataaagccaactcagattggcaatacgggattatcgtgcccggaattgcaccatttgttggtggtctatgtgccgcactctttatgcggagtttctttggcatctaatttaatcggaggaatcaaccatgcgtgaacaaattaaacaaacgcaaaacatgatggtcgacttattcgaagtcgctgctcatgcctcacaaccggggacaatctcaaccagtttaattgaagcgcaacaagcgcttttaacagcagaacaactctatggtagccttgatgacgcgcaacaaaccgctagtcaatcaactttcaaaaactttgttgatagtgccgcgcatttaaacttgatgatcgtcaagagtttagataacaacgatttggtgtatgccgatcggattcaaaatgaattaacagctttaaaacaattaatctaatgatatagaaagaagtctttaacaatgaacacattatctgaaaaaaaagcaatgttaactgccaatttacaacaaatggaaaaagtgattgttgccttttctggtgggattgatagcacattagttttaaaaatggctttagaaacactcggcaaagaaaacgtcttagcggtcgttgctaactcagaattattcacagacgaagaatttaacaaagccatcgacttggcacatgatgtgggcgcgaatgtcgaaacaacaacattgaactacttatctgacgaacacattgccaacaacacaccagaaacatggtattacagcaagaagatgttctacacacaattgaaccaaatcgctgctgaaaaaggctttgaccacgttttagatggtatgatcatggatgataacagcgacttccgtccaggtttacgggcccgtgacgaagctggcgcagaaagtgttcttcaaacagctggtttttataagattgatgtccgtcaattagcaaaggcattaaacttaaataactggaataaagtagcgagctgttcagtttcttcacgtttcccatacaacacagccttaactgaagccaaaattgcccaagtgatgcaatctgaaaaattcttgcgtgatttaggttttgcaacggttcgtgttcgttaccacgaatcaatcgcccgggttgaagtcccagaagcacaaattgctgacttcttaacccacagcgaacaaatcaaccaagcattacaacaagctggttttgaatttgtaacggttgatttagctggtttcaagagtggccggatgaatgaatcattaacagcagatcaaaaagcagctttaatgactgcttaatctgagattaagtgttttaaaggctgggacaaggtatctttgtcccagccttttttggtagcgaaaagtgtttatccgtgctttaaaagcgaactatgttaaactgttatagatactttttaaaatgaggcgaaaaattgtgaaacatatttatttagataacgcggcaacgacacccatggccccagaggtcattgcgacgatgaccgaacagatgcaggccgatttcgggaatgcatcgagcacccattattttgggcggcaagcccacacggtgttggataccagccgccatactttggcacagagcattcatgcgaaagataacgagcttatcttaacaagcggcgcgactgaaagtaataacacggcaatcctccagacagccaaactgcgtgctaaagaaggcaagcggattattacaacggcaattgaacatcattccgttttaaaaccgatggcttatttagaaacgcaagggtttgatgtggtttacttacccgtcaacgaacaaggggtgattgatctcgcagatttgaaggcggctttaacgcccgaaacgattctagtatcgattatgatgggcaataacgaagtcggcagtcatatgccaattcacgaaattggtgaacttgtccgcgactcaaacgcctggttccacacagatgctacgcaaacgtatggcttattagatatcggtgtgcaagctgacaatatcgatttactggcagtctcagcccacaagattaatgggcctaagcaaatcggcttcctctatgtcaacgacgcgattcatttaccatcatttgtcctaggtggcgaacaagaaaagaagcgccgcgcagggactgaaaatgtgcccgctgtagctggttttgcgaaagcagttgaattgttgacaccagcggttaaagcagacctacaagcacggtatgctggattcaaacagcaattactagctgatttaaaagccaacgacattgattttgcgctgaacgcagaaggcgctgatcaagtcgggcatgttgtgaacctctggattaaaggtgtttcaacctatgtcttgcagatgaatcttgatttagcaggctttgcaatttcaggtggttcggcatgtactgctggcgatttggaaccctcacacgtgttgatcgcgatgtatggtgaggctagcccgcgcgttgccgaaagcatccggattagttttggtcacgaaacatcgagcgaagacgtcgctgcttttgccgaagcgctcacgaagattgtgaaacgcaatttagcaaagcaagccgctaaggggtaggcagcgtttacgtgcttgtgctaaaatagacttattcagtgtatggaggttaggcagatggctttattaaaaacaacagcaacggttttggggagtacggtgcaatatcgactcaatcccgccgttaaaaaatacacattaagagatgttggctttgtgcccacaaacaatggtaacttccaaatggaacgaccattagatcctaattcaccatttaatagtgcgattaagttgaagatgacagttggtaaagagttacagacgttgaagatgtcagtcacctctccagatggcttacatccagtcgatattttcaagagtgaaaagaatgctgaaaacgtcgaacaatttaattttattattgctaacttagtggcacgtgaagtgttaattaaagaaggctaaatggtagattgcaaatttaatttagtttgaaatattaaccaagattgctataatggtaagtactggaattcacgaccttcaaatcgtagaaaactagaatctatttgaaatgatggtgatattgtggttgaccacagtaatacacgagtcgtcgttggtatgagcggcggggtggattcatctgtcacagcattgttgttaaagcaacaaggatacgatgtgattggtgttttcatgaaaaattgggacgatacagatgaaaatggtgtctgtaccgcaacggaagattatgaggatgttgccaaggttgcttctaaaattggcattccttattattccgtcaacttcgaaaaagaatattgggaccgcgtgttcgaatatttcttagacgaatacaaacacggcagaacgcctaatccagacgtcatgtgtaacaaagaagtgaaattcaaggctttcttagattacgcaatggaattagacgctgacttcatcgcaatgggccactatgctcagattgaacgcgatgataacggcatcgcacacatgttgcgtggcggtgatagcaataaagatcaaacttatttcttgagcgctctttctcaagatcaattacaaaaatcaatgttcccaatcggtcacatgcaaaaagcagaagtgcgtcggttagctgaagaggctggcttagcaactgctaagaagaaggactcaaccgggatttgtttcatcggtgaacggaacttcaagcaattcttaggcgaatacttaccagcacaacccggtaagatgatgacggtcgacggtcttgaaaaaggcacccatgacggtctaatgtactacacgattggtcaacgctccggtcttggaatcggtggcggtggcgaatccaatgatccatggttcgttgttggtaaagatttagacaaaaacattttatatgttggtcaaggctaccataatgaattactctatgctgatcaattagatgcaagtaatatttcttggatcacaccagttgatcatgggacagattttcacgtgacggctaagttccgttatcgtcaacaagacgtcggcgtaaccgtccacatgacatctgacacaactgcaacggttgtctttgatgatccagtgcgtgcgattactcctggtcaagcggttgtcttctatgacggcgcagaatgtttaggtggcggcacaattgacgtggcttataaggctgcgaacgatgatgctgacatgaaagtattacaatatatctaatttaatcgttaaaagtgctgataaacttatatttatcagcactttttttgtgggtttgttcaataagtggtcaacgaccttttttagaataaaatcacaatataacgtttaaaacataagtggttattcgttttagattgtgaaattaatttaatagctggaggcaattgacttttcgaaactaagtagcgtacaatatagttacacgctaattgcgtaatatttcacaaattctcaacgattaaccgtcgttttttggatatttttaggaggtaacatgatgaaagtagcagttattggttgtacacacgcagggacatttgcaacacaagcaacattggcagaacatcctgattgggatgtaacggtttatgaaacacatgataatttatcattcttatcatgcgggattgccctttgggtgggcggccatgtagccgatcctcagaaaatgttctattcaaatccagaaatattagcgcaagcaggcgctcacatgaagatgcaacacactgttttagaagctgacttagatcaaaaaatgttacgcgttaagaacttagtaacggaagaagaaacaaccgaaaaattcgataaaatcatcgtcacaacaggctcatcacctgtgattccaccaattgaaggcatcgacaatccgaacgttaagctctgcaaaaactgggcgcatgccaatgaattgaaaaagagcgccccagatgtgaagagtgttatcgtgattggttcaggttacatcggtgccgaattggcagaagcctatgcaacaactgataagcaagtgacattaatcgatgcattaccacacgcactcggcaagaatttcgatcctaatatctcagaaatcgtggaacaagattaccgtgaccacggtgtaaccctcgcgcttagcgagaaagtggtcagtttctcagggacggatcaagtcactgttaaaactgataagaacgaatacacagccgacattgcaattttatgtgttggcttccgcccaaatactggccttttcaaagggcaagttgatatgttaggtaacggtgcgattttgacggatgaatacatgcaaacgtctgttaaggatgtttatgcagccggcgattcagcagctgttcattacaatccaacgcaaaaagcagattacattccattggcaaccaacgctgttcgccaaggccttttaatcggccgcaacatcgaaacaccaactgaaaaatacatgggcacgcaagcaacttctgccgttgaattatttggtcgcacctattcagggagtggcctaacagttgaaggcgcgaaagtgcgtgggattgaagtcgctacaacaacgttagaacaagattaccgccctgatttcatgccatcaacgacaccggttttgatgaacttaatgtgggatcctaagacgcgtcaagtattgggtggttcattcacaagtatgtatgatattgctcaagcagcgaacgtcatttcaatggccattcaaacgaagatgacgattgatcaattagcaatggttgacatgttcttccaaccaaactacgatcaaccagtcaactacgtcaacgcaattgcaatgcaagctgtcgcagaaagtaaataaaagagtgtgtaagtaagcgttcatattttgaggattaactggatttggcaaatagggttaaccgcagaaatatgcctactgaaacacgtttagagcaactaatagatgaaaccgctaggataaaaagtatttttatcctagcggtttttttgatggcgttttacaggaaaaatgcttgctttattagtcgattgacttgaatttagggcgtaactctttcataatgaaaagtaagttattttaaggagagaacgcatgacaaccttatattttatccgccacggtaagactgaatggaatttggaaggccgctatcaaggtgcacgcggtgattcaccattattagacagtagttacgttgaaattgaagaattagccacatttttaaagcccattcattttgatcatttatatacgagtccgttaaaacgcacacaggtaacgtctgcggcgctaaaacgagacttagggcaggattttccgattacggttgttgatgcactccacgaatttaatctcggtctaatggaaggaatgcgctttacggaagtcgaaaaacaatatccgacaatcgtgaaggcctttcgtgaagcaccagcggagtatgatccaactgagattaaaggggaaacctttgaacaagtgattgaacggacgacgcaggcaattgacgcaattgtgaaggccgctaaaccgactgatcatattattattgtcagccatggggcagcgatggtggcgatgatgcagtccttactcaagacgccattggctcaggtccgcaaagacggcggtgtgacaaattcatctgtgaccacgatgacaactgacgatcaaggagcatctttcaaactaattaagtggaatgatacacacttcctcagcaagcaattatccgcaatagatacgatataggagatgatcacgtgcaagcaattctagcaaaatgggccgctggcgaccacgaagccgctgttaaagatctcgtacaatatttacaagatcactcagaagacattgaagcttacgttacccttgcgacatttttaacgacgcttaaagattttgaacaagctgaagcacttttgcaaaaagcgttgacgcaatttcctaatgaagctgcattgacttacgcattaggaacactctattatcaagcggaagcttatcaacaagcggtgcccttgttcatgcagttggtgcaagactcacaatcaacagatgcgcagtatatgcttgcgcagacatatcatcaactcgaacagaatccacgggcattggcgttcgcgttgaccgttcaagaacaagaaccagaccaactagacgccaatcttttagtgggcgatattttaacgagcttgggtgattttgaccaagcgcagacctaccttaaaaaggcattgaccattgcacctcaaaatggtgaagtattatttaagtatggcttgacgcaactggtcttaggcgctgatagtgagccttatttcgaacaagccaagcactatgcaccggattattttaaaaagaataaacaacagttaattgatattgaaggcttcatgcaggctaaaaagcaaaaagaataagggatggcgattgtggatatagcaaaaacagacgaaaccaaaccaacagtcaccggaaccgtccagagtattttctatgagagtccggataatttttttaaaattctactcgttaaagtagcacataagacgattgactggcacgaaacagaaattgtggtgaccgggagttttggcgacattaaagaagatgaacgatataccttctatggcaaagtggtcactcatcctaaatatggcaaacagtttcaagccgataattaccaagtggaccaaccaacgactaaggccggcttagtcgcttatttgtctggcgaaaaattcacaggcattgggcagaaaacggccgaaaaaatcgtggatactcttggaattgacgcgattgataaaatattagaggatccgacggcgttagaaccattggggctaaatgcgaagaaacaagcacaactcgttgaaacgctgacgattaataatgggatggaacagattattattggcttaaacaactatggttttgggagctcgatggcctataacatctatcagacctaccatgaagatacgctgaagattatccaagaaaatccgtaccaactcgtggctgacattgctgggattggctttaaacgtgcagataatttagcggagaccctcgggtttgccgctgattcagccgtgcgggtgcaaggggctttaatgcaagcgttaaatgagttgaccaatcaagctggggatacctatacccaggctaagccgttattggcagctagtattgagttgatggaaaaagcacgcaatgttgccattgatccgaatttggtggctgaacaactgatggcacttgcacatgatgggaaagtcgttggtgatgagaatcggatttatccgaatgggttatttaatgcggagtggcaaattgcgaaccatttaatgcgaattgaaaatgaacgcgatcaacttagctatcctaaacatgatctagatcaagaaattcgccacctcgaaaaacggtttaagatgacatacgatgacgtacaacaagaggcgattaagcttgcgatgactcaccgggcgttcttattaaccggaggacctggtactgggaaaacgacgattattaacggaatcgtgacgttatacgctgaattaaacgggctgtcattagatattaatgagtacaaagacacgccgtttccgattttattggccgctccaacaggtcgggccgcaaaacgaatgagtgaaacaacgggtttgcctgctagtacaattcatcgcttactcggaatcactggccgcgaaaataatccagatgtttccggtaacaaagaattggaaggcggcctattgattattgatgaaatgtcgatggtcgatacttacttgtttcgctcattactacgggcggtgcccagtcatatgcaggttgtattggttggggataaggatcaattaccatccgtcggggcagggcaagttttctttgatttattgcagagtaaggttattccagcggttgaattacaacgtatttatcggcaagatgaccagtcaacgattattccgttggcgcatgaaattaatcaaggccaactgccagcggatttgttgaagccgcaaaaagaccgcagtttcattcaatgtaatccgtatcaaattgaatcggtgattgaacaagtcgttactaaggccaaagcgcgtggttttgaaaccaaggacattcaagtgttagcgccgatgtacaaaggagcagccggaattgatcagttaaacccgatgattcaaaatatcatgaatccaaagctagatgaccgcaaaaaacaagttagcattggtaacgttcactaccgcattggcgataaagtactccatctggtcaatagtccggaacaaaatgtgtttaatggtgaaatcgggcagattacggggattacctatgctaaaaagagtgcggacaaggttgacgagatcaccattgcttttgatagtgcagaagtgacctataagcggagtgagtggcacaagattacattggcttactgtacgtcaattcataaggcgcaaggttctgaatttgaaatggtgattctaccattggtcaatcaataccaacgaatgctcaagcgaaacttactgtacacagcagtcacgcgggctaaatcattgttgattctgattggtgaaccgagtgctttccaaaaagcagctcaggaactttcggccaatcggcaaacgacgttaaaagaacggattcaaagtgtctttaacggtgaacaactcagcaccgccattaagacggccagtgtggggcagacagaagccaaaacaattgttgaccagccggcaccaccaagtgcgccagaaacggctgttgatgaacaactgaacttagtgccagaagacgacgacgcaatacaagaaacgccaatcagttatgtcttaacaccgactgttctaacgcaacagcaagtggatccaatgattgggatgaccggggtgacaccgtacgattttatgccgaaatcaaaatagtgtataatagggtaaacaactaacgaaaaatgaggcgaaataatggttgaccagcgatctaatttagagattagacccgtgacaattgaacatttagaacaatttaatgacttattacggtatgtttttcaagtcaccgatcaggaagtttctgatagtggctacgaagagggcgaattagaacgcgccaaacgtcccgtattagaaaaatctgacgtaatcggatggtttaatggggacgaactgatttcacaattagccatctatcattgccgcgtgaacattcatgaccaggtatttaacatgggtggtttgactggtgtcgggacttacccggaatatgccggtcatggtttgatgcatgacttggttaaagtcggcttgaacaagatgcgtgagaataagcagtggatatcgtatttatatccatacagcattccgttttatcgtaagaaagggtgggagatcatgtctgatcacctaacttatgatattcgtgatagccaattacctaagcaacggccggtaaatgggcacgttgaacgccttgatattgacgatgaagacgtgattaaaacgtatcaacggtttgcactaaaaaatcacggtgcaatgattcgtaacgaactgaactgggatgaatattggcgttgggaaaatgaagaagaacggattgctggtgtttattatgatgaaaatgaacaacccaccggctatgttttatactggattgccaacgaagtcttccatattaaagaaatgatttatcttaatcaagaggcccggattggtctgtggaatttcattggcgcgcattattcaatgattgaacatgtcaagggtaatcaatatcaggatgaaccgatttcattcttattagaagatggtgatattgaccagacgattaagccatattttatggcgcggattgttgatgtgcgtgaattcttgttggcttatccgtttgaaacggacgggcaagcattccacattgaattgaccgatccattagctgaatggaataacggtacgtttggcgtttattgggatgaacaaggaaaagtgcaggtcacaagtcgcccagtcggtgaacgaattcaatgcgacatccagacactaacaacaatgctgatgagctatcgacgcccatcatacttggcaaagattgaaagactccaagccaaccgacaagcactaaaaaatctcgagaatattattccaatggaccaaccatacttctcggattacttctaaagaaatgagtgcattcaagtttggtcaacttttgagcactagccttgtgttgctaggcacaggaacatgatttgaagagcacgttaaaaggcgctgcccccaacttggaggcagcgccttttatttatttatgcttgcttctttagccaaaatgcctggcttttaagactgtagtgaatatcaaatgtccggctaccaagttcttcaccgtccatttgcccgaattctaatgtttttgtttgaatcgctaagttggttccttcaaagtgatgcaccgcttgatagcgtgtgtgccgaccaaacaacatcatcacaaaaagatagcaaaagaaaaagggattcaatttttcaatcacaattaaatcaagttgatggttgtcgaccgttgcgctaggcatgatggggacccctccgcaaaagtagggatggttagtggtggtcactaaaaagccacgtttaaaataatgattttggtgatcagccgtgacggtgacttcaaatgcatcttggtgcataaaaactttaaccaatgagctgatgtaagctaatgagcctaagtgcaatcgatttaaaagtcgtttatgatttgaatgattggtggtgctgaccacgttggcatcaaaaccaatccccacagtgttaacgaagtagccatggtcgttcttcgttgtgtcatgataataacccaaatcgatggcagttggcattgtggccgacaagatttgttcgagtgcggtcaatggatcacgactaatcccgacaccacgggcgaagtcattacccgatccacaaggaatgtaagcaatcggaatatcgccgcgctgagcattctggagaccattaatggcttgattgagcgtgccgtctccaccaataattaataaaatttgatccgtgtacttaaactttgcaaattggaaggccaattgggtcgtgtgacctgcgtagtgggagagttgcaggtcatagtgaatttgtttttgttttaattgagtttcaattttaggccagatactcgctgcctgaccggtaccggcaacttggtttaaaatgatgtaaaaatggggattggagggcatgaacaagccgcctttcagaaaaagtaatctgttgtatattatagcggtttttaccaaatgttgacaataaaaacttgcattaaacaataaaaaaagcgccaggtcatatattgacctggcgcaaaacttattattctgtactttgaatgatcattggtaaaatcattgggcggcgttctgttttttcaaacaagaagtcttgtaagccatcaatgattgcttcgcggacttggttttcagtgaccttgtcgttagcgttaaacgtattgacgatcattcggaaaactcggcgttgggcttcgctaatcaattcacctgattcacgcatgtagacgaaaccacgggagaggatatctggaccagcgagaatgttcttttcaccaagattgatagttgccacaacaacaaccaaaccttcttctgagagcattttacgatcgcggagcacgacattgccaatatcgccaattccgttgccatcaacgtaaacgtcttcggcgctaaagtgaccagcaacccgcgctgagtcagaagtgagtgctaagacgtcaccgttttcaaggatgaagcagttatcaggttccacaccacattgttgagcgagttccgtatggattttttgcatccggtattcaccatgacaaggcatgaagtacttcggtttgattaaccggagcattaatttttgttcttcttgaccaccgtgacctgacgtatgaatgttattcactttaccgtgaataacttcagcaccagcttctgaaagcttattaatcacgtggttaacgctcattgtattcccaggaattggattacttgagaaaacaacggtgtcgccaggttgaattgaaatttgacggtgagtcccattggcaatccggcttagagcagccattggttcaccttgagatcctgtacatagaatcatcactttgtcggcgggcaacgaatttaattcattggcatcaactaaagcttcatcgggaatatttaaataaccgagttcacgaccgttgacaaccgctgcttccatactgcgaccaaagacggcaattttacgaccgttagcaatcgcagcatcagtggcttgtgagacccgtgaaatattagaagcaaacgttgcgaaaataatgcgaccttcaatgcgttccacaatatggcggattgaagtgccgacgaaacgttctgactttgtaaagtttggtacttcggcattggtactatcagacattaaacataaaacgccttcttcacctaaacgtgccattttttgaagattaggggaaggttgattaccaaccggggtcaagtcaaacttgaaatccccagtttcaacgattaccccttgaggtgtatgaatcgcaacccctaaagtatcaggaattgaatgggtagtccggaagaaatcaacacttgttttgcggaatttaaggacggtatcttcgtttagttcgtgtaattctgttgaccgcaaaaggccgtgttcttctaacttaccgcgaatcaaggcaagtgccaatggaccagcgtaaacgggtacattagggacttgttgcaagaagtaaggtaaaccaccaatgtgatcttcatgcccatgggtaatgacgagggctttgatcttttgttggttcttttgaaggtattgatagtctgaaataacataatcgatccctaagagttcatcttcggggaatttaatgccggcatcaatcacaataatttcgtcttggaattgaacaccatacatatttttaccgatttcaccaagtccccctacggcgaaaacggcggtttcgttattcttaatatcgagtttcatttaattaaaactccgttaatttaaaatcttctgattcttgttcaaaagcaaggtgcttaccagataattcttgtacaaattcaatattgtagggagtattgtcttcaacaagttggcgtgcttcaacggcactgtctgcttctaaatagatcgatttagttgcctcgcgtagagggctttgggttttgtctgcttggaaaagtactttataaatcaattgtggatcgcttatttcacctcagcatgccctattttattcttggtcttattctattcgttgccgttttgatttatcagtatcattttttctaccccagtcacccgaactacaatcctaaaaattatcgcattacaaaaatgggctgggcaaccaccgctgttgggtgtcttatcatacttcttctaatcttattttcaagtggttcaatttggatttggcccgcttttctaatcgccttcttaatacgcgattatttctcaactttaaaataactataagtatcaaaaaaatcgtccgtaatctcaaaaataagattacggacgatttttattttaagatgtgctttataacactaagctaatcgtcacaaacacactttaatccaaaacgtgcttcttgtcaccgtaatttccgcttaatctaacatcgtattaatgctcaattactaaccgccacagccagcactctattgccattcttcgtcatttgctactggtagttttgcccagtagttttctttgtttgtttgacgggcacgggcgatggccattgccttttctgggacatcatccgtgatggttgagccagctgcaatgaaggtgtgatctgcaatttcaaccggtgcgacaatgtttgagttgctaccgatgaagacatggctgccaacatttgcgtggtgtttagccacgccatcatagttaacaaagactacgccacagccaacattaatatcagtgcctaatgtggcatcgccaacataacttaaatggccaatcttcgtgcgatcgccaattttagcattcttcacttcacagaagttcccaacatggacgtcttcgccaatttcagcgtttgggcgtaaatgactgttaggcccaatgtttgaccccgtgtgcatgatagctgattcaatcgttgaacttgtgatttgaatgttgtcttcaattgttgaatcaataatagttgagccagcaccaacgaaacaatctgaaccaattgttgtgttcccttttaagacgacgttaggttcaacaattgtatcattaccaatctgaacgcccacttcgatataagtattttctggatcaattaatgtcacaccattacgcatgtgtactgtattgatgcgtttacgcatcacttttgttgctgcagcaagagcaactcgatcattaacacccattgattcttcaaagtttggcattctgtaagcagcgacaatttcgccttttttcttcaagatttcaaccacatccgttaagtagtattcaccttgtgcgttctcattcgtcacttcgtgcaaagcttggaataaggtcttgttgtcaaagcaataaacgcccgtattaatttcattaacagccgcttctttatcattagtatctttttgttcaacgattttttcgacaatcccgatatcattccggataatccggccgtaacctgttgggtctggggccgttgctgttaaaatcgttgcctttgcgcctttatcatggtggtatgcaaataatttttcaaacgtttcagcggttaaaagtggcgtatcgccactgaccacaatcgtaatgccatcttcatctttcagtaaagcttcagcctgtaaaaccgcatggccagtccctaattgttcagcttgtaatgcatattgtgaccggtcgccgagataatctttcaccttttcagcgccgtgcccaacaattgtgaccacattggttgggtgcgttctttcaacttgggttaaaacatgatctgccattggtcgaccacaaacctcatgtaatactttatataattttgacttcatgcgagtacctttacccgctgctaaaataattgcatttttattaaccatcataagctcctcgtcattcgtgattactggtctattttagcttaaatactaggctagagcaagctaatccgtattgaagtttagcgctttatcccgtatactggaggtactttattgcggaaggaagtcggccatgccaaaactgacaaacaacattcgattaatgctcggcagcatcattgttgccattgccttactagttggtgggtattggtctacctcagctcggcatcaaacacaccaagccgcagtcacgtcctctaccaaatcacaatcgcatgcgaggcaacaatcgataaaatcaaaaaaagcggctcacccgacaccaattgactggcgtgcgccttccgaaaacaaaccatatcctaatttagacgaacaacccgatttatgggtcgacgtttcaattgcacagcaacgtgtctaccttaaaaatggcaatgatcttttgtacacaatgcatgcttcgaccggttcccctgagtcacccacaccaactggtaccttctatatcgaagctgaacacggcgactcatttttcaatgcaaattccggggaaggtgccaaatattggcgctctttcctagatcatggtatttatctttttcacagtgtgcccacagatgaagctggcaatttcattccagaagaaacagagcaattaggcaaaaaagctaattcacacggctgtatccgtttatcagtagctgatgcccaatggttctataccgcaattccatataatacaaaagtcgtcattcactagcttgaatgacgactttttacttaataacgttcaaaaggagatgccctgatgactcagccaacccaacaaacgattgccacggcttttaaacaattaatggttgaacaaccttttaataaaattagcgtcaccaccatcatgaataaaactggcattcgacgccaaaccttttatgactatttccctgataaatatgcgttattagattggatttacgatcaagaaatcggtgtctacatcgacgagcatctcagctatattcattggacacagatgttggcgcaactatttaactacttcgatgctaaccgcgccttctatcaaaatgctttgtcgattgaagggcaaaacgccttcgaacgccattttattcatcacgtccaccaactgattaatcggattattcaagatcttgctagcgcccatcacattacgttatccaccgactaccaagcctttttacttagttttctttccaacgcattagttgcttacaccgctgaatggctccgcagtcgtcatccccaatcagtttcaaaagtaatcactgccctaaaaatgacattaactgatacaattaacggtttattattacggacaggacacttatatgaacaacggtaattataagataatcccatcaaaatttaatttcatatttattgaccattcttagcgtagttggcttccacagctgctttttctgcttgccaccagtcttcattgtcacgataccagtcgatggtatgttgtaagcctgatttaaaatcagtgaattctggttgccagcctaattcttcccgtaatttcgttgaatcgatggcataccgtaagtcatgacctggacggtctttaacttgatcgtaagcatctttgggttgccccattaattctaagattaattccaaaacatctttgttattttgttcgccgtcggcaccgattaagtaggtttcaccgattttgcctttggttaaaattgcccaaacggcgcttgagtgatcattcgtatgaatccagtcacgcacgttttgtcctgaaccgtaaagttttggtcgaataccacttaaaatattggtaatttgacgaggaatgaatttttcaatgtgttggtaagggccataatttgtttgaacagtttgaaatggttgcttgtaggccgaatgaacgcacccatgcccggactaacaagtctgagctcgcctttgatgatgaataagggctacttgggttataacgggtttcaggagtgaatttttcaccaacgacttcgccatgaccaggtaagtcttcacgtaatggtaaatcaccgtatacttcatcggttgaaacgtggtgataacgcacattatacttgcgacatgcttcaatcaacgtatatgagacgataatgttcgtttgaataaagagtgaaggatctttcaaagagttatcgttgtgactttcggcagcatagtgtaccactgcgtctgtcttttgaactaacttatcgactaattcagcgtcacagatatcgccaacaactaattccacacggtctgctggtaaaccggctaagttagcgcgattgccagcgtaagttaatttatctaaaaccgtcacgtgaacttctggatggttattcaccacataatgcacgaagttagaaccgataaagccggccccaccagtaacaataatatttttcaacctgaatcctcctaataatatgttaatcatagtattcattcttaatttatttaaatataacagcaatatctatttaatacatagcttaccgtattttaaaatcacattaccgtcctcaacaatattttaaagttattactagttacattattaaaaatcatcttttcttttgaatattattctatataaaaaactgcttaaactcagtctccaaaacagacatcattttaagcagtttttacttcttatttaatcttcaacggtgctaattgggcttcaattgcagctaaatccgtccctgcttgcaacaatgccgctgccgtatagcaaccttcgattaaagcaacatcgtatagatgcaccgttttatccgttagttcttgggccaattcgaggttcatcttagcgctccctaagtcgtagaaggctaacaattcttgcccggcattggcttcaaaagcactttgaatcttcattgcgctagtcccaataccaccttcgtccgtgccaccagcagtcgttactgaaacatcagcggcaacttctttaattaaacgcgctacaccggccgcaatttctggtacgtgagaaacaatcacaacaccatattcactcatgataatacccccgccattaacattgtagtaaataaatacccactagaagccgcccctggatcaacatgtccgattgagcgttcaccgacataagatgcccgacctttggttgcttgcatatctttggtcgattcgacggcagcttcaattgcagccacatctaaagtaccatcttcaaccgctttgacaacgggagcccaaacgtcaatcaacgtcttttcaccaacttgtgcatgcccgcgtttttgaattccttctaaaccggctgccaacaatgggccgacttcaagtgtcgtactgcttagttttgccatttctaaaaaggctgtcccatagagtggaccagaagccccaccaactttgctgatgagcatcatcgcagtcgttttcaaaataccttgtacatcggttggctgttgcttggtcaatgcgtcatgcacagctaacaagccccgcgacatgttattaccgtgatcaccatcaccaatcggtgtatcaagttcacttagataatctttttcagcttggatttttgcatcaaacaattcaagccatttcaatgtattttcaactgttaacatggtatctctcctttaccaaccaatcgttgtgactggttcatctaatttagcaacccaaccaggttcaattaatttcataattgttaatgacacaccggccatatctaaagaggtcatgtaattgccgacttttgtgaagtcgacttcaacattttcagcggccaagaggtccaagacatcattcataaagacatattgttccatcagtggtgttgcacctaagccatttaccatgaccgcaaaatgttcgccggccgtcatgtggtgggcttcttttaacttgccgactaattcagttgctaggtgtttcgaatcttgtaatttttcacggcgataacctggttcaccgtgaatccctacaccatattcaatctcatcaggcgctaattcaaaccccggttttccgacctcaggaacggttgcgccagataaggcgaccccgattgtcttaatattcggtgtaatttggtgcgctaattcttcaattgcttcgataccagcaccttgacgggcataagcacccagaatcttgtggacgaagattgtccccgcaacaccacggcgtccttgcgtatacgtactattttcaacagcaatgtcgtcatcaacaacgattgagcggacatcaatatcatccatagctgccatatccttcgccatttcaaaattcatcacatcgcctgaataattcttaatgactaagaacacaccacggcccgcgtcagctgctttaattgcttcataaatttgatcaggtgttggtgatgtaaagacttgtccgcacacagcggccgtcaacatgccatcgccgacaaaaccagcgtgcgttggttcatgaccactaccgcccccactgacaatcccgacttgtggtcgatgttttaaatcggcgattttcatcactgcttctgttcctggaatttgtttgagttggtctggataactccgcactaaaccttggaccatctccgttacaatttggcttggatcattcattatttttttcatagtaacctcctcttaaatataacttcagtctatgttaccgctgtcatttatgcaacggacaaagcttggaaactgtccgaaagcacttcaaataaaaaaagcacccgcacaattaacctgtccgggtgctatcaaatcgtttaagctaagcgatctgcattctttgttaagtaattaccataactgacacttaacgttttattttcaatatcaactttatcaaccttcaagattgatgtgtaatcatcaaccatccgattgccttcgaaatctgattcagcaaagacagaaatgccaaccatttcagaatcaaactcttcaatcaagctcttcatcccattgacggtgccgccgcctttcatgaaatcatcgacaattaagactttggaattttcaggtaagctgcgctttgaaagttccatcttttcgatgcgagctgatgaaccagaaacatagttcacactgaccgttgaaccttcagtaatttttgaatcacggcgcacaattacaaatggcacatttaagtacatcgcaacgctctgtgcgattggaattccctttgttgcaacggtcataacagccgtcacttctttacccacatattggttggcgattaaacgcccaacttgccgtaatacttctggacgtccaagtaagtctgataaatagacgtaaccaccaggcaataagcgatcattttctgaaagccgttgtgccatctcagcgataaaagcttctgcttcatcttgtttaatcattggcatgtagcgcacaccaccagcagcgcccggaaccgtttctaagatccctgtgccacgattaaaaaaggtccgcttcacaattgataaatcttcactgattgatgacttagctgattcgtaacggtttgaaaagaatgtcaatggaatcaacgtatgtggtctttctaataaatagcgtgtcatatcgattaatcgatcgcttcttctaactttcatgttgaatacccctctatatattactttactgttatttccgaaaaaaactgtctaccaatcaattatatagaaatcttcggttaaatcctagtcttttaaaaaaaaagagcttaattgttcgcttttatcccattaaagcgattcccacgccaattaaaaatgcctcaaccatttgattgtcggcgttttattatggtttcaatggtttaaccagatatacctcagcgcaaaatccggacatactattataaatccgttgagcccgtgaatactgactacagataccaaataccgttggaccactaccactcatctgagcaacatccgcaccaaactgcaataaccgctcacttaattgcttgataactggataacgttcagtcgtaatcggtgctaaaacattccccatattgcgagtcattgcatttaaatctccagcttcaacggctgcaaccagcgcctcagtttgtggatgctgttgaatctggtcgcaatccaatgcacgaataatccgcggcgtcgaaacactgacttccggtttcacgacaacgacccaaaaattcggtaatgatccgagtggtttgatctgatcgcctttgccagtgacaagggcggtttctccatatacgcaatatggcacatccgaatcaatttgtagccctaatcgcgccaagtgttcgcgtgttaaaccaagttgccatagttcgtttaacccccgtaaaacagcggctgcatcagaacttccgccgcctaagccagccgcaactggaatatgcttatcaatttcaattaaagcaccggttggaatctgataggtgtgttgtaataattgagctgctttgtaggccaggttacgctgatcttctggcaaaaagccacttgatgtgcggacctcaattgcgggatcatcgcgtaatgttatctgaacatagtctgccaaatcaatcgacgtcatcaccatctgccactcgggttccccatcgtcatgtagaaagagtgcatctaagctgagattgattttagcaggtgctttttcaattcgttgcatcacattcaccttttacctagcatttaattgtttcattatactcatatctgcttgtaaaaaccaaccttttaacaatgcatccaaaaaagcactgacaatcatctgtcagtgctcttcagtcgacattattgattatcttttaccataatcttatgtctaaattcattcattaaatcaagcatctgcttggcatttttcttgccaaacgtctccatccatgaggcaaaccgattatggatcttcggatttaattcttcaactgttttttgaccagacggcgttaaatttaaaatcaaccggcgccgatcatcgggatcaatttcttgtgtaatatagtctaatttaagtaaaacacgaatctgtcgagaaattgcaccgcgtgttacgcctcgttttttagcaatatcaattagactcactgaattatcatcagcaatctctttcataatcagatattgttcaaaagacaattggtaagcttgcgttggttcagaaaccaagtcttcgacatatttaatcgccgacatgtaaagttcaacgtattcatccaacaattgactatctttcacaatatttcccacctttttatttattttcttaactgtaccacaaatctttaagcttgactatttggtgtttgcgttaacttttgttttaattctccgccgaataggcctgcgaagaacaccccacaaaagacaagtaagataaacaagactaatccgagttgaccaccgttaccattaacgacttgttcaaagccactaatcgtgtaggtccctggtaagaagattgctacgccacgatagaagcctgataacatatcgttcgggaagagtccccctgtaatgatgagttgtaagaacaataacccgaaggccattaaaattcccatcgttccaaaaagtttatccaatgctaaacatgcaagggtaaagaccgcactcgtcatcatgcttaagacgaagaacgcgaacggttgtgcaatcgtcaatccaaaaaggtttgcaaagatatcaattaataaggcttgtgcgacaactacgccagctacaaccaacatccgttgcttaagaccgctatgtgccaatgtttcaccatagcgataaagtgttaattgcgtcaacattgccccaacaaagaagacaagtgttaagactaatggcgagaaggtattaattaatgagccatgatttgtatctgatagtaattgatctttgactggttgcacgaaatgttctacatttgcggaacctgttgaaagattggcaacttgcttgctaccatcgattaacttgacgtttaataagctaatcccagcacccgcttggcctaagccagtcgttaattgtccagcaccatcagccaataagcctgaaacctcgttaatttgtgtaataccagataccaaggttggtgccttttgatttaattcttgtaaaccattcgttaattgatggctaccattgttgagctgttggacgccactgccaagttgactttgtagtgtttgcaatccattattcaattgttggccaccatcattgagttgttgcacaccacttgccaaagctggtgtttgcccatttaatgtttgtagaccagcttttaattgttggccaccattgttaagttgattgttattagcgactaattgattactccccgcagctgcggttgaaacgccattcagataagttgttaagcccggcatcaatccaggttgaccaactttgccttttaatccttcttgaatttgaactaatccatcatgaatcatgtcagcggcttgaatcccgcccattgtatcagctgtattgcctttttgtttcaagccagtatcgactttggctaaccccgctgtcagtgtatcaatcgcctgtgtggcaccatttagcgctaatggcgcttgatctttgcttgccatcttcgcaatgccagcttttaattgggccatattatcagcagtcttcgttaattcatcggatactgcttgtaattgaacacccgtatcactcatattattgcccatcgtgcctaaattcgcttgaatagctttcatattcgttcctgaagattccaattgactacctgcgttaagtaagtcagccttagtcgcatctccaatagctaataattttttcattatatcttgattttgggctaagaatattaagaatttagaattatgatacgctaaatcttgtaacgcttgtaattgagtgccagcatcttgtaagctgctcgcgacactatctgttttatcggtattgtatactttatcgttaatttgacttaaattagacccactatcttgtaaaagggcacccgtatttttcgtattatccgcaatcttcaataagtctgctttgataatttcggaattatcattattggaatggttaactttttgatctaactcttgaataccagcatttaaagcgcctaacccagccttcaattgtgttaattgttctttattaccatcaagactcgcttcgatttcatcagctgccgcagtcaacttttcgctcaactgcttagtgccatcagctaattggtcgacaccaccactgatttgttgcccaccagctaaaattgtttggttattggctgctaattggtttaaaccagcattaatttgacctgctccagctgtataatctccaagcccagttgaaagttgcccagcacccgtcgttaattgttggactccactttgaagtggggctgttttgccagctaattgttgtaagccacctgaaagttgtcctgaaccagtaacaagttgttggacaccagatcccgttttgtcagataattgttgtaagccatctgaaagctgacccgatccagttgttaattgttgcacgccacttgccaatggcgcactaccatctgccaattgttgtgtcccactatgcaacacatttaaattatcatagatttgttggctcccatttgataattgaccggctgctgtgtttaactttttaacgccattgctagcttcttgtacgccactgcctagcgtgccgattgcaccaagcaaggcttgattataagcttcttgaattttttgaacgacactgcccttcatttggttcacgacttgggttgtaatcatgccggccatgtagttatttttcttagacgtttcaacttttaacaagctgactttaggtgacttatctaacgcggttgtcgcatttttagaaaagtctttcggtaagacaacctgcatcgcgtatcgaccgctagctaagttcgcttttgcatccttagcactgacaaatcgccaatcgacccggtgatcattgcgcaacgtttttagtacctgttgcccaactgccacctttttccctttaaatgttgcggattgatcttgattcacaaccgcgactttcatatgtttaatattagtggtctgttcgtacttaataaaattaaatgtgattagtaatagtaaaatcggaattaagcagatcataataatgaacccacctaacttcactttattctctctccaattgccaaacatattctttctcccttttgtatacgtcataaacattctatatgatattgttttatcaaacgaatgtcaacatctaatcaaccacgtgaagtatatggcgattcgtcaatctgccttttgaacaaaaaaaagcactcaacccgttggttgagtgctactctattcttctattttaaactataggacaattggttcttcatcaaactcaatctcaatcgatttcgttaacaaatcagcatagctgtatgaaacacgttcaaaagcattttcatcctgatctaaatcgactacaaatactgctggaaaggtttctttaagaattccctttcgctttgtaacttttttgcgcccagcttgagcgacaaccattaacttgtctccgatatgcccatcgagaccgttcttaatattggcaagtgtggttggcattatgcttcacctcttcgagggatagtataccatataaacgaaaaatttgcaattataccattgtaccaacgatttggcaattacttacttagcttttttagaaaaaattggctgattattcagcgcatcgcttaattgggcaaattgttggatactcaattgttcagcacgagcgctcggtgcaatctcgactgcttctaaggctgttgttaaagctgctttgacttcatcttgtttaccaaattgattttgcaagttattccataatgtctttcggcgttgtgcaaatgcgccacgaaccaattgatcaaataaggtttgattagcaactgttacaagcggtgctttgcgccccactaattcaacaatcgctgaatcaacattcggttgtggcataaaagctgtcttgggcacaataaaggctaagttcacttctgaatgaagttgaacggcaatacttaatgagccgtaagcctttgaaccaggttcagcgttgatccgttctgccacttccttttgcatcattaagaccatgcgatcaattggcaatcctgcttcaagtaagtgcaacatgattggcgtcgtaatgtaatagggtaagttcgcaacgatttttagattatgcttaccatcgaattgttcagcgataattgtttttaaatccgcttcaagaatatcttggtttaaaatcgtgacgttatggtagtgattcaaagtatcttttaagaccggcattaaccgttcatcaatttcaaaacttaatacttgatgcgcttttctggcaatttgttccgttaaagaaccgatcccggggccgatttcaatcacatcgtcatctttggtgatatcaccagcttcaacaatttgtttcaaaatggcgatgttggttaagaagttttggcctaagctctttttaaacttaaagccgtaacgtttgagaattttccgggtacgctcgggatttgcaatatcttccatattaatctcctaattcctgtttaatttgtaatagtgcagcgccaaattcagcttgcgtcacttggaacatcttgaggcgcttgtaaagttgtttgctgttggtgtaaccgatgtgcaaaatttcgccgagtaattcgcgccgccgctttgaatcagcccccgcaatcaagcccgccattaataaatccgattgactgatttgttcgtctgcttcttcatcttgtgttaatagatgctcaagtgcttggacaatcgccgctggttttgcgtgttcaatgcctaaactgccgcctgctttttccggacgtgcttctgtccgtggtaaaaaggcgtgttcgacgcccggtacattttgagaaatgattttacgaatcttctcgccatgaaaatcgggatcggtaaagacaatgaccccgcgtttttcttgagcgagcgcaattttttcgataatttcttcattgattgctgaaccgcgcgtttcgattgtcgaaacatctgggaaaacttcccgtaatcgcttcgtatcgtcgcgcccttcaacaacaatcacttcttgaattgtttttttcatagtgctcctaacttaaaaatccggtgggcattcgcatacgtcgctgccgcaatttcttctggtgccacatctctgagtttagcaatcgcttctaccacataccgtgtgtagcctggttgattctgcttaccacgataaggcgtcggcgttaaataaggtgcgtccgtttcaaccaacatcacgtccaatggacatgctttagctgcttcatggacttcatgcgcatttttaaaactgaccacaccgctgaacgaaatctgcatgccaagatccataaaccgtttcatccattcaacatcgccattaaaactgtggataatccccccacaatcacggacatctgtttcttttagaatcttgtacgtatcttctaacgcgtcccgcgtgtgcactgaaattggcatatgcaaggatttagcaatctcgatttgccgtgcaaaaacggtttgttgcacatcgcgtggcgaagtatcccaatgataatccaaaccaatttcacctagcgccactacttctggtcgttgtaattggtcaatcagcacggtttcttctgccttgtgataatccttggctgattcagggtgccagccgataatggctgataaagtttcatattgcgctgctaagcgcaaagcgccctcatttaatactgtatctgaaccaacaattgccatttcaacaacaccgagttcagcggcttgcgcgataaaatcagcttcttgccctgcatatggggtatcattcaaatgcgtatgtgaatcaaaaatttgcatttcaatctccttttagtgtcctcattctgacagttaaaacgtgctcttgccagtagctttctgcgctttgttacactttcaaaccggcgattccatcgccaattcgccaagttagacaaatgctcaaaagctaaccactggcaacacactcttattttaaacgtgctctgtcagccaactctttccggttaaccctaaatgtcaaacgattgctacgcaatcattcgccaatttgtgttaattctcaagagctacccggctgatatcacactcttaattttaaacgtgttcttcaaagctgattcttgtgcttaacttaatttgtcaaatcagcgattacatcgctaatttgacaaattaagttaatgctcagaatcaatccgctttgaatcacactcttttccattaaaagggctaaaaggcctacagaatgtaaatgccttttagcccttttgacgtttctgttattttaaattaaccgatttgtgagccgttcaccaagttgtttggcacaactgctaattcaacttgtccgtcatgttctgctgataacaacatcccttgactcaattcaccacgtaatttacgtggctttaagttcgtgacggctaacactttcttaccgactaacgcttcatagtctggatagaattcagcaatgccggaaacgatttggcgatcaccttgatcgccagcatctagacggaatttcaatagtttatcagcgccttcaaccttggcaactgccttgatttcagcaacgcgaatttcggtttgatcgaaatcttcaaacttgatggcgtccttttcactgactaatgttgttgcttttggatcgaattcagctttggcttcagctgcttgttgcttagccttcactttttcgttcactaagcccgctttttgcgcttgacccatttgatccttaatatatgcgacttcttcatccaagtctaaacgtgggaagattggggtccctttagcaaccacctgaatattggctgggaatgtcccataaaccaattcacgttgcgcaacttgatcgaaatcaagccctaattgtgcaaacatatcacgtggtgcatgcgtcatcacaggttgtaataagagcgcaacaatccgtaaactctcagccaagtgggctaagacactatcgagttccgctttgcggctgtcatcttttgctaagacccatggttctgtttcatcgatgtacttattcgcccggctgattaattgccaaacggtatctaaggcatcagagaacttcaattgatccattaagctggtatattgttcgatggtttgtgcggctgtcttttgtaagtcagcatcaaacggtgtcacgtcagcttggtaagctggcacagcgccattgtcgtacttgttaatcatcgcaatggtccggttcaacaagtttcctaagtcgttggcaagatcgtaattaatccggctaacgaagtcttccggtgtaaaggtaccatcattaccaaatggaatcgcgcgcattagatagtaacgtaaagcatctagaccataacgttccactaacatttcaggataaactacgttgccttttgatttagacattttaccgtctttcatcaacaaccaaccatgaccaaaaatttgttttggtaatggtaagtctagagccatcaagaagattggccaataaatcgtatggaatcgtacgatttctttcccaactagatgcacatcagcaggccagtatttattaaacaattcgtcgttgtctgaaccgtatccaagcgctgtgatatagtttgataacgcttctaaccacacgtaaaccacgtgcttcggattacttgaaacgtgaattccccagtcaaatgagattcgagaaaccgataagtcttccaaaccaggtttgatgaagttattgatcatttcattacgccgtgatgccggttcgatgaaatctgggtgttcttcataataagccaataagcgatcagcatacttgctcatcttaaacttgtaagtttcttcagcgacccgttgaacttcatgaccagatggggctttcccaccgatcacattgccatcgtcgtctttataaacttctgctaattgtgattcagtgaagtattcttcatcagaaacagaataccaaccttcgtatttaccaagatagatatcgccttgcgctaataacttgtcgaagattttttgaaccgctttgacatggtattcatccgttgtccgaataaatttgtcatttgaaatttcaagagtttgccataatgctttgatgtctttagccatgccatcaacatattcttgtggagctaaatgcttttcagctgctttttgttcgattttcaagccgtgttcgtccgtccccgtcaagaagaagacatcaaagcccatcaagcgtttgtaacgcgcgatgacatcggcggcgattgttgtatatgagttaccaatcgttaatttaccagatggataatagattggggtcgttacgtaaaatgttggttttgtctctgccattaggttcgctccttaattaaaaaaacgagaatcttaacaattctcgacttgcttaaataatgccatataagtaatcaaagtatagcacaaaagagcagtcatttaaacgacaactcacactaagccttcattaaaataaatcaatctgttcaggtgctttcggggctaaatcaggaaattctagcccaagtaattgttgtaattgcaaagcattatccgctgcatccccaccagaattattgttaaaaatcacggcaacttgttccgcttgatttttaatctgccgcacagcatccgcaaaaaattgtaattcatcttgatcatagcgatacaatgttcgttgcttccgccattgggcacccggattctgccacccggccacattacgaccatgcaggcgcaacatcgcaaacgccggattggtgacaaccggttcaaacggcacactgttcgtcggtgtttgtgcttcgtctgtgatgacgtgtgtcatgtttagctgcttcaaaaaggcgtacatctgttgcttaaaagcgtcatcgtaccaggattgatgccggaattcgacagcaattggcacatccggtaaccacgcgcgaatttgtcgtaaatattgactattttcctgattcagttgaaaaaatggcggaaactgaaataagaccgcctgtaattggccggccttaattagcggttcaattgattggcgataccgcacaaacaattctttttcagtactcgtaaactcggcgtagtcttcttggcgggtcattgcttggtgtgctttaacaatgaactgaaaactggctggtacttgcgtcaaccagtttgcgctgacggttggtgcgcgtaagccataataaaaactatcgacctctaccactggcagaaattgcgcgtagtcgtttaacgttaactgctttttgctgggcattaatgactgatgttctgaccaagtagttaatccaattgttatcatatccacacctctagaaccgttggaattgttgaatgaacaaagcttcttgttccgttaaatccttcaatgtgacaattaattgttgtcccatgcgtttataatttaaccgaatccgcgataggctaaagtcgatgactagcagcagcaacattaagctaatggcgcgcccctcagaaaacgccacccctaaaagctgtacctggcccgttgcagttaagaatttaaaaataatgtataacgagaacagttcttcgacgactctaaaaaaacgaatcccttgcaacttcttctttaaaaccatcaagaccatcatcgtttggtcctttgtcatcatagtgcttcctctccttctcttggttcagtaatgggaattgcttcaaagaaaatcatctgatctgcatgaaaatccgtatcataccgattgagctgaccacttaaaacagttggtaaaatggcctgtaagtctgccacaattccttgattatcagcagcttgtgcccattctggttcaaataattgaagcacgccttcgcgcattccgaccggataaagtggtagttgcaccgttggtaaaatatcgactaaaaaaatgtcaatcggtgcaatcgtttcaccgtcgatgtgccaatcaatccaccccgcattttggagtgtgtattggttggtttgtaaacccgtttcttcaaataactcccgttgcataccactgattggcgtctcatcgggttctgttttgccaccaatgccattccaaagcccagcaaatgggggcttaatccgattcaataatagtaaagtcccgcgatagcgaattaccgctaaattatagcgtcgtttagtcacagttcaatagcctcacatctcataaattagtttcattttagcatattaagcaaaagagtgctgactgtcgcggtcagcaattgagcattaattcaaaaatggtattaatccaggggtttaggattaataccatttttagattaagcggaaattactgcgacaggaagcacgtttagagtgtctgagtcgaacgggttggctttgaggattaacaaaaaaatggggattatggcgctcttcagccatgattgccatttttaggttaaccggaaaaggcagttcgaatcggcacgtttcaaattagagtgctgaatctgccggttatatcttgaggattagcagcgcatcgtgaatgagcgacgaagtcgatcgtttgcgatacgtagctaaccggaaagatatggcagactcggcacgtttccatcaaaaaagagcgctccgtctccgtttcgctctttccacattatttttcttctgcttctttcatcgccttcatcaattttacttgatattgtttcgaaattaaaattaacgtttggtataaatcccttacgtaatctgcgagtgctggatctttaaccgcagcaaggcgcgcatccatcaccgctttttcgcgttggatgtccgtcaagccgattttttgttcatgcttgattgttgcaatttgcttggtgacttgcatgcgttcttcaaataaaaccgccaattgggcatcaattgcatcaattttttgatagtgttcagttaacatgggctcactccttagttgctagtgcggcaaaaacggttgtcgcatccgcttgtatcatagtgactggcatttcaaattgtaatgcctcttgattaatcgctactaattgggcatctggacggcgatattcaattaaactcgcaaatgggtaaacacgaaatgacgtcccgaccacgacaattaaatccgccgcttcaatcgcctgaatcgaccgttcaatcaccgtcggatcaatcggttcttcatataaaacgatatttggccgcaaaatcccaccacaatcttgatgatgcatatcctttaaataggcctgataaggcactgattggccacacttttggcagctgacacggtataaactaccatgaaattcaatcacatcccgcgcgcctgcttttgtgtgcaacccatcaacattttgggtgataatctgccctttttgattcgcaatcgtcgccatcacttggtgaatgacattggggtttgcttcaggaaaatacatctgctgcgtgacaaattcataaaaactggctggattggtgattaaattcgtgtgacttaataaatattctggattggcttgctgacgatacaaccccgttttcgatcgataatctggaatgccagaagccgttgacacccccgcacccgtcaagaaaacaacatgctgtgccgcatgcaacattgatttaaaagtcatcaccatcactcctttttaacgtgcttttaattcgcagctttctgcgctttgctacatcggtcggccaatcgcctttggcgcttatccgtctgattaggcaagtgctcaaaagctaaccgcgaattaacgcactctgttctttaacgtgcttttcaagctaactttctgtgcttagcactgtgaatcaaatcatcgactgcgtcgctaattcgcttccctgtgctaatgctcaaaagttgaccagcttgaacgcactcattttcttaatgaatacggcattccaatttcatctaagaaggcttgcactgataaatcatacaatcgtttgaaatattccggtgttgccttgtcttctggaatccctaagacaaaagcattttgttgatcactcttaccaattccaacatacgctttttggttcgttgcggtcgcaaataaattttcggaatgtaaaatatcgtagacttggcgcacttctaatcgtagttgccgttcacttaataccggcgtcaatgtcaagagttgttggaggttcgtttcagcaaatcctagggttgataacacgcgatcaaacgcaacccacaagttaatcacagcccgccgtaatgtgaatggtgaatcaattgttttgcgtgccaacacatgatagagaatttcggcttgggcaaacgcaatcggataatcagccgtccactgttttaacagttgttggttgccaccatcaaagaagacgagggcatctaacagcgttaatacgcggaaaatcacccatctattttcgggatcgtctttttccggggtcagattatctcgtagaccttcaaggtaggcttgtttagtttcaacatccacaaagccatgggattcttgttctttttgaatcaccatatgcacagcagcattgtacaacgttgtgccggtcgcaaccaattgttcatcgagttgcgcatcctgcgtggtgacatcggtcatgatttgtggaaaaccgattgataataatagtaagtgtaataattcatgtgataaagcataatcggccgctgtcgcatcggtaattaagattgccaagctgccatcgttatttaaaacgcgttgtgcctgatcatgttttaacatcccagacgctgcgtctgcgacccggatcttaatgggttgaggataattcttttgaacctggtcaattaaactttggatttctggggaaaattcagtagttgtcatttttggtctcctttgagtaaacagctttgcttttcatgataagccaaatccagttaaattaccaacggtttagaatgtatgaaagcggttaaaactgttataataaaggtaatcttaatttaaaggacgtgttgactatgacagaaccaaattcgcgaaaagtaattttataccttgctcagagtctagatggcttcatcgctgaaaaagatggtagcactgcttggttagctgcactcgattcatccgaatcagacgctgcaattcaagctttccaacgcaccgtcgataccgttgtgatggggcgtaagacatatgaacaaagtcttaaattagccggcacctatccttaccaagataaaaacggctatgtcttctcgaaaacgttacatgatacagaagatcgaacacatgtcgttgctgggaatattcctgagttcatgcgtcaattaaaaaaagaagatggcggcaatatctggcttgtgggtggtgcagaaatctttaccgaattgcttaaagcccagttagtcgatgaactcatcatcaccattgcgccagttcttttgggtgacggcatttcactggtcagcacgcacttaaccgatatgccattggaacttatcaatagccgtcaaatcggtcattttgttgaattaacatacaagattaactattaaaaatcaaacgaaaaggcagccacaatattttgtcgctgccttttcagattaaagtacgggggaatgaccaatgaaagccaaccttaaaatcccacttattttattcatcgctttatgtatcagcggcctctgccagctgttgcaccaagatttcttcgctgtgcttgtgatgctcatcgcaacaatcagttgtctgataattgcctttaaaaaccggcaagctagcggacgttaattcgcaacgcgctcataatcacgagcgtctgttctgtgctgatggtcgccccacgtaataattcgagcgtgaaagtcgctttttcgaattgattctgactgatatcgagattcttcaaattcgtgccagtcatatccatgccgttcaaacgattcccgatcattgttagccactgccaatcaacttgcccgagtgagacttcttgcatactgcaatctttaaagtcgacatgccgcatccgcgcaaagttaaagccggtgtaatccgcttggcaagtgtcgaacgtgacatcattcagaccagcctctgcaaaatcggaaccaatcaactggcaaccattaaacgcgactcgttggaagggatcattcgtcaacgaacagtttaacaacgcgcagtgttcgaattgcacatcttgaaaatcacagttattaaagtcgacttgttcaaactgacaatttttaaataaacagcctttaaagaataacatctcaacttcggtttgcttcaacgttagttcttcgaaaaacaaaccttcataagtctcatctggttcaaacgcagtaagctgtaccgtctcaagttgtggatttagccgcggtgcctgtgctttcttatctgtcatctaactgtctcctgtctattgtgattagtataccgaaaattgtcgccagtgacgacctgaaattcaggaaagccttttcttttcattaatggtactttgtggtaggttaaaagcatcaaataaaaggagtgattgatagtgcaaaaaatcaatgttggtggcagcggcttaatggcttcgccaattgtctggggtgtcatgcgcatcccacaactgagcgaccaagaagccctgacaatgctcgaaaccgcctatgaacatgggattaattactttgataacgctgatatttacggcaatggtgcttccgaaattaaattcgggaacgcccttaaggccagtcatattgaccgtgatcaagtgctcgttcaaaccaaagtcggcattggcaaaaaaatgtacgacttttcaaaggaacacatcatcgaaggtgttgaagccagcctcaaccgattacaacttgatcatgttgacaccttactgctccaccgacctgatccactcatggaaccggatgaaatcgctgaagccttcttaaaattgcaaaatagtggtaaagtccgccaattcggggtcagcaacttcaatcccggtcaagtcgacttactccaacaagcagtgccgcaagcattgattgctaatcaactccaattcagtttgatgcacactggtatgattgatgccggcgtgcataccaatatgcaagacgcgcgcagcattcatcacgatggtggtttattagaatactcacgcctcacgaatatgaccattcaagcatggagtccttatcaatacggcatgtttgaaggggtcttcatcgataatccgaaatttccagaattaaacgcagcactccaatcagttgccaaggcacatgacaccaacgtcaacgcaattgctagcgcatggctcctcagaattccagccagcatacaagtcgttgtcggcacaatgaaccccggccgcctagcacaaatctgcgaagcagacaaagtcaccctcaccagaagagaatggtacgacctatacttggcagcaggcaatgacctgccataaagtgctgagatagccgtttatcacttgaagattagcctatcaccaggaattatggtggtttccggccatgatttttgttgtgtagtgaaccggaaggttatggctatcgaagcatgtttaaagtacgtttaaaacggttagtttctaagtaagtagtaattgtgcattaagcaaaaaaagcgccgtctcaattaatcttgagacggcgctttttttggttctacttaattctgataaggattgcctgcatactgatccaccaccgccatcgatccatcgtaatggccgcgaccggttgcatagtcaaattgcatcttaggttgtacattccaaacatacgcattaaagttcaacttcttatctgttgagattgcttgaacccagtaaccgcggggcatcaattcatctccacggaacacagttgtcacttggtaaatcacctttttattttgcgttagtgcttggcgaacctggtcttcaaaaatctgcatggtacgttgattgctgaagaccgtttgtgtcgctaagttcttcggattattgctactgccgagttcccctttttggaaaacaccatctcggttgaaattaaacgaaatcgcgtatgcaatcaaatggccgcgactttcaggaaagacccgttggccatcaatcatcacgggttgattatgccagccggttggttgccacgtttgacgatggcgtgtgtttgaacggcctaacgtctctttcgataagaaagccgtattagtcgttgtccgatttaaaccatccaacgcaccatacttgatccgttcggtttgccattgacggacatccaacgttgatttattatggttcacttctaaataggcattgtcgcctgacttaaaggtcttctcagccaagattgccgttgtttttttaacttgttttttatttgcaattgttggtgcattctcgtgcgttggttgactagattgtgtcgcctgacagccacccaacgccaacatggtcaacgataagccgaccaataaatactttttaaacatcctgttcctccctattcttacctgcttcacgacgcttcagttggtgcattgtcttgaaataggaactcaatagcaccaaacatgaaccaatccaagcgagtgggttggctaaacttgcgcccatgaagccgaattgctgcacgaggaagatcccggcaaaaatccgcatgaacaactccgcaatccccgctaaggttggaataaagctctgccccaaaccttgcaaggtatagcgaatggcaaataagattgccaaaataaagtaacaactactgttaaagcggaagtagatttgtgctaaatccgtcacgtgcggttgattgttcccgataaacaggttaaccagtggtcgtccaaaggcaatgatcaacgcgcccatcactaaactaaagatgattgacaccattagtgtctggcggacccctttactgattcgttcaaattcacgtgcaccgtaattttgtgcggaatatgtcgccaaggtaatcccaaatgaattcccaacttgagttgctaattgatcaatcttcccagccgctgtgtaagcagcaaccgcgctagcacccaatgtattcaacatgatttggatcacgattgagccaattgcaataattgacgattgaaagcccatcggtaatccaaccttgagatgatccatgacatctttgcgcgtcacgcgaaaatccttcggccgtaaaacgaggaccggaatgcggcgataaatatatagtaagcataacacagccgcaattatttgtgcagagaccgtcgcaaacccggccccttcaacgcccatatgaaagcctaaaataaaaataaaatctaacacaatattcacaatgaccccaattactaagaaaaagaggggggttcgactatccccaagtgcgcgaatgatattcgaaagtaagttaaacgccatcgaggcaaaaatcccaccaaagataatcataataaaccgttgagcatcaacaatgatgctggccggcgtcttcatcatgaccaaaatatgtcgagcaaataatagactaataactgtcaaaatgatggttatcaccaaactaatcagaatgctcgtcgcaaagctgcgcttaacgccgcgatagtcttgagcaccatagcgttgggctgtcaagatggacaacccagccgtggtccctgtacaaaaaccgataatcagcatgttcaatccacccgttgagccaactgctgctaacgcattaacaccaattgtccgcccaacgattaaggtatcgatgacactatagagttgctgaaaaatattcccaatcaataatgggccggtaaataagataattaatttcaacggattacctttagttaaatcatgcatatcaattctcctttgctccatgtcgataacttctcaaattatacaccaaaaacagcgtttacatctgtcttaaattgaattaagtctctcatattcaactttaaagtaccatcaaaaagcatctattatcccactatattagtctataaaaaaacagttaaacaagtcattcagcgacttgtttaactgtttttttaatttgaataggattagttaaagtaattaatccccattgcatcccgcacttctttaagggtttgttctgcaacagcattggccttcttgctaccttcttctaacatcttataaacggcttctggattcttttcaaattcagcacgacgttcacgaatgggtgcgaacttcgcttgtaagacttcgttcaagtaacgtttgatcttcacatcacccaaaccaccagcttgatattgcgctttgagttcagccactttttcacgatcatcatcgaaggcatctaaataggtaaagactgtgttgccttcaatgtgaccaggatcggttactttgatatgcaatggatcagtgtacattgacatcactttcttttcaagcgtttgggcatcgtctgataggtaaatcgcattgcctaatgacttactcatcttggcgttcccatctaaaccaggtaggcgtccttcgccttttggtgggaagaccccttctggttcaactaaaatttcttgtccgtaaacgttgttaaacgtccgtacgatttcacgggtttgttccaacattggttcttgatcatcaccaacaggaactgtcgttgctttgaacgccgtgatatcagcagcttggctgactggataaattaaaaagcccgctggaatactttgttcaaaattcttttgttggatttcagctttaacggttggattgcgttgtaaacgcgaaaccgtcacaaggttcaaataatgcatcgttaattcactcaaagcaggaatttgtgattgcacgaagacggttgttttagcgggatcaatcccaactgataaataatccaaagccacttggaagagactgttccggattttttcaggatcacgcgcattatcggttaaagcttgttgatcggcaatcatgataaatgtttcgtattcgcctgaatcttgcatcgctacccggttgcgtaatgaaccaatgtaatgcccaatgtgtaatttaccggttggtcgatcgccggttaagataatttttttgttcataataataccctccaatttgatttatcaactcaaaaaaagcgccctaattgtgattaaacaattaggacgcttctacgtggtaccacctaaattgcacgaaaatcatccgtgccactcacgcgataagggtgctacccgaattagttactcactaattcccgattgaaggcccaattcacaaccaacttcttgacgacttctcagtcccgccgcttcctgttcaagaaaatatcagttgctacttatccttcactttgtctgttgaattactgtcatactaatggattttaaaatgaatgtcaatcggtcgcttttttaccccaagacgcttataatataacaactaacaattggaggctgctatgttacacgaagacacaaaacaacaagaacaagcgcgcgttgaccgcacagttatacaggtcgaccaacgcctcacagtgattaaccaacaattggccaacgcctacaatgaaaccaaagacatcgaacaacgttacggcgacaatacgaaagtcaacattaccgaagtcgatgaccgcatggaaaccaacgccgcggtccaacaacaaaagcaattggtcgccgccgctgtcgaaaacgaaaaattactgactagccaacaagaacgcctgaccgatctcgtcaactccccttacttcggtcggattgacatcaccgaagatggtgaaacggaatcactctacatcgggaccgccacttttatcgacggccaagacaatttcttaatctacgactggcgcgcccctgtttcgagtatctactataatgggacactcggtccagtgacttatgagacgccaaatggccctgtcaaagttgacctcaaactcaaacgccaattcaagattcaaaacggtcaaatcgaacacgtctttgatacgaacgaaactgtcggcgatgaactcttacaagccgtcctcggtgaacaaagtgacgaatacatgcaaaacatcgttgccacgattcaaaaagaacaaaatgatatcattcgcgatacaaccgctgacttactgattgtccaaggagtcgccggtagtggtaaaacctcagctgtcttgcaacgcatcgcctttttactctatcacagccgcagtcagctcgaagccgaccaaatggtgctcttctcacccaaccgtttattcagccattatatttcagaagtcctgcctagtttaggcgagaaaaacatgcgccaagtgacgatggccgagttcttaagtcatcgcttctcaggcttacaggttgagaacctcttcgaccgcttcgaaaaagatcaagccagttttcctgaaatgacacaagccatgcgccggtataaagaaagcgcagcgttcatgcacgcaattgaagcttacgttaaacaagcctcaacccaaccgttggcattcaacgatctatacttcgaagaccgcccattttttactaaagaccagatgaatcagatttatctcgcactccccgcaaatatgttacccggcgacaaattcctcgccactaaaaacacgctcatcaaacggcttaaacgccaaatcaacctcgaagttcatctcgactgggtcgctgaaaaaatcgataccttaaccgatgatgcttaccggacgattgtcggtgaccgcgaattcgattctggcgatgatgaacaagctttcatcgctcgtgaaatcgttcaaagttatttcgccccactctatgaatcaatctacaatgattatttcctagatgaatccacagaatatcaacacttcttaagtggtgcttgccctgccgacatccctacgaaggtttgggacgccatgattcgccaagtcgcggataacaatgaacgccacatcgtcgggctcagtgacgccgccccaattctatacctgcgcgacttattaactgacagcggccaaaatcacggcattcagtacctcttcatcgatgaaatgcaggattacagcatcgctcagttcgtctacatccaccacgcctttcccaacgcgaaattaaccgtgctcggcgattacgcacaggatgtcttcacggcgacctaccaaaccggccacttcatcgatcaactgaccgctgcttttccccgcttaaaaatcaaccaaattagcttaaccaagagttaccgcgcgaccgccccaatcaccaacttcgccaaggcactcttgccaaaagaaacagccctccaagccttcagccgtgacgggcgcctaccgcgcgtcattgagacgccaaacgaccaagcgctcgctacactgacccaagaaatccgccatctccaggcagaacacgcgaccgttgcgatcctcaccaagaaccaacaagttgcccaccaactctacgctagtttaacacctgatgaacacgtcacactcatcggtgaaacaacccgtagtttacccaaaggcatcctaatccttccattatacttagccaaagggctcgagttcgacgctgtgattggctacgacatctctaagaagaccttcggcgcacaatcagacgtagatctcctctacacactcgtcacacgtgctatgcacgatttaacactgattggcgtggatcagctcagtccgttgatagtggcactgccgacggacatctatactaccttacaatcaactaagcaatccatttaagcaaaaaagcctgtcgaaattatcgacaggctttttgaattcgtattttatgcaccgtatggaaaatccaaaccagggactgcatttaaacttagatcagcaaattgttgtttttgtaattcgatatgcgctgcggccccgatcatggcgccgttatcgccgcataatcgaagtggtggcatgatgaggtctaaatccattccggatgccttaatggctgtcgccaaaccttcacgtaaaccttgattggcagccaccccaccggccacaacgagttggcgcacgtttaattgacgcgcggcgtgcatcgttttagtggtgagcacttcgaccacactcgcttggaaactagcggctaagtcttcgtggttcagcgtctcaccgatttgatcggcatggtgcactgtgttaatgaaggcactcttcaaaccactaaagctgaagtcaagattatcttccttgagcatcgcacgcgggaatttaaatgtatcttgacctaagtgggcaagccgatcgatttctttaccggctgggtattgaatcccgaggacgcgaccaattttatcgtaggcttcacctgctgcgtcatcccgcgtatcaccgataatttcgaattcgccggcggctggcatgtacaccaattcagtatggccacctgaaaccagtaaagctaacaatgggtattctaaaggcttaacaaaccgcgccgcataaatatgccccgccatatgattgactggaatcaatggtaagtggtgtgcgtaagcaatcgctttggcagctgtcacgccaattaataaggcgccgactaatccaggcccataagtgactgcgaccgccgttaaatcagcgtaagtaaccccggcctcttctaaagccgcttgtgtacaaactgtgatttgttcaacgtgatggcgactggccacttcgggtaccaccccaccaaaacgttgatgactcttaatttgggtagcaatgatgttgcttaaaataacatgaccgtcttcgatgacggccacactcgtttcatcacaactggattcaaatgctaaaattaattctcgtttttccgacatgactgactcctattgactcaatatccgacacatactgaatgcatcttctttttcctgaatgtaataattgggacgcgtccgcaccactgtaaaacccaatcgctgataaacggcttgagcgcttgtgttgctggcgcgtacttctagtgtaattttttgactgggataatcgtgggctaaactaaccatttcgtgcaccaaaaagtggccaataccacgtttttgataacttggccgcaccgcgatattcgtaatatgagcttcattggttgaaaaccatgcaccgacaaacgctacgacttcagtcccttggcataaaaccagatacaacgatgtcttgcgcttgctcaactcactagtgaaggcccaacgatcccacggcgtctgaccggcatagaccgaccgttcaatgtccaacaatgccgtaatatcattttgactcgcgcgtgctaagtaaaatgtcgtctcatcaatttcaacgcgccgagttgtgtaaggcatttctttcttgacccaaatctggggtttgaggtattccctaaacttgttccacatacgaatcagcgcctcgctcatcatgcgtttttgcccagttaacttctgcttccgtcttgcgtaaataaacgggtccgaagccatggatatccgagacaggttcagccatcaaacctaattcacccaagacgctggcgtgcggtaaattatggttggcggacacgaaatgcgcgttacttcctaatgcagcttgaatctgttcgttaaagtgcgcaacgtcattccccacaaaataaacgggttctgccaataattgtaattgtgccagtagtgcttctagtgaaacgtgttgatcggccacaacggtttgcaatgtcccattttgccactgatagatccccgcgaaaacattgtcgcggcgtgcatcaaacagcggtacaatcaaggcggtcgtatccatcacattggccgctagcaatgctaaactcgaaatcccgaccaatgacttattaagcgtccaagcaaaagacttagccgttgtcaccgcaatccgcaatcccgtgtatgaacccggaccttctgcaacgacaaagcgatcgatatcttcaatggtggtttttgtttgttttaatagttgatcaatcattggaagtaatgtctgactatgtgtttgacgaatattaacagtcatttcgcctaaaatttgatgatcttcaaggagtgccacactcaccgcttgattcgaggtatccattgccaatagcttcattatttcatccttcttctgcttataatccttgttattctagcataaaaagccggtttccacaaaaaaaggcgttatcttcaaatagataacacctactcatttataatactctatcttttaatctaataatcggttcgaaatgcatcacgatgtatagaataatcggatgaatcactaatgtggcagcttccccaatggcccgcgccgtaaagtggaacccaaatggtgtatgactaataatcgacacccaccatgaattcaaaccgaggttaacgatcagcacaactgtcacaacggcggcaatcacgcgccaccatgtaatcttttgtcggtagaagtaacacccatagatgaaagcccctagaaacgctgaaagtgtgaagcctgggaaataaccacctgggaccccaatcatcaaactattgatgaggtcgccaataacggcggcaagtcccgcccaaactgggccaaaccaccaccccattaaggcggtgacgatgaatccaaaactaattctgaaaatcgttagtgaaattgcaaagcgtgcaaccaccaattgtaaagcaattaaaacagctagtaaaacaacgcgtctagtgtctagcttaacaccaaaaatctgaccattaaccataaaaagcatctcccttttggagctgccacaaataatactgcggcgaatgcggtactgaaatcgcaagcattgctgcttttcgtctggtgtccacattccgttccaccagcacttaacgcttcagtcctactccgaatttttagaaccccttaaatgtatcactaacgttatttaattacaagcaattgattttcatttttcagcaactcttgcagaaaatttgctatacttacagatgagtaattcggatttaaagaaaggtgttcattaaacatgaagaaaattttagtcctccatactggtggcacaatcgcaatgtctgcggacgaagatggcgcggttgcacccacagatcaaaatccaatggccggctttgaaaagctgttcgataatcaattaatcattgaaagtgaagagttcgccaatctgccttcaccacacatcacacccgctgtgatgttaaaccttaagaatcgaatccaacaagctgaagaagacgggattgatggcgttgttgtcacacacggaacggataccctcgaagagaccgcctatttcttagacttgacacttcccaacaatatccccgtcgtcgtgactggtgcgatgcgctcgtcgaatgaaatcggcgcagacggattacacaacttgattagtgccgtttggacagctgcttctgacgatgcccatgataaaggtgtgctagtcgtgatgaacgatgagattcacacagcacggtatgtcacaaagacgcacacgacgaacgtcgcaacctttagaacgccaacttttggtcccatcggtttggtcagcaaacacaatgcgaatttcttccaagaattaattcgttctgaaatttgcgacatcaaaacccttgtcgaacctgtttatcttttaaaagtatacgctggcatggatgggactttattcgacgccatcaaccaacccaacaccaaagggctcgttatcgaagcactcggggctggtaacttaccaccagcaaccttacccgctgttcaagcgctattagatcgcaacatccccatcgtacttgtttctcgctgtttcaatgggattgccgaagacgtctacgattaccaaggcggcggtgtaaagcttaaacaaatgggcgtcaccttctgccaaggcctcaatggaccaaaagcacgcctcaaactacaagtcggcctcagcgcaggcaaaacaggcgcagcattaaaagaatttgtcagcaacgcaacatcatagagtgcgtcatcaacggttagcttctgagcacttgcctaacttagcgaattgacgctgtaagcgccgatttgataagtgtagcaaagcgcaggaagctgttgatgaaaacacgttttcgatagagtgcgtttgaaacggttagcttctgagcattaactggatttgccgaattggcgatgaaatcgccgatttggtaaattgggttaagcgcagggagctgtttcaaaaagcacgtttcaataaatattcgaagataacaaaagaaagcccatcacaactttatctgtgaatggggctttctttcgtttaaacgtgcttcctcgaactgccttttccggttaactgaataattgggattatggctaagactcgccataatcccaattatcccgttaatcctcaaagccaacccgttcgactcagcgctctttccacgtaatttccgcttctgctgcacttaggtcatccacggcgactttatgccgtgttgtgattatatcatcaactgtgagttgttcgaccatgctttgggtcatttgaccgtattgaatttcgtggccgtagcggatgttgacacttgctacgcggtgtgtcgtcaagaagtcataatcgagcgcatccaacatccattcaaaataatggacgttattaacgtgttgattaccatcaatatcgaaataacgcacacgatattctttggtcgtcacttgttcgggatcaatcttcttaatccgtgggaatcgtttgctacctttaatctcacttgactcgaatggtgccatgatttccggcacaacttgcaccatactccgtgtttcatacgacatcatcacgaagatgctttggacgaagacgcattcgttgccggcttcatcatataaccagaaattccggtaacagaaatacttgttgtaactctcagcttcagtcacaattttaactttttcatccaccttcggcatccgcgtaatcttcatttgatactgcgtgaccacccaaccaagattgagcgcatgcattgtcgcttcaccgacgttgagcgcattgagttgatgctctgatgctaaaattaaaatgttcaccaaggatgcaagcgttaattcgcccttgatatccgtttcgaaatacggaatttgatagttttctgaatattgctttcctggcatggcgtgacctctattctgttaattcgtggtaggcattataaacgacttgctttttcaagccatttgccttagcgaccgtcttaatcgccacgttggggcttgctccttgttgaatctgggcttccacttgttcaggaagggatagcgattccgttacaactgcactgaccgttgcatctggtgctggatttccagcaactatcatcacaaattcaccacgtaattctgtttcagtcgcccaagcaagcacttcttctaggtcgccacgaatgaattcttcgaacttcttcgtgagttcgcgccccaaggtgactttgcggtcggcgccaaacgtactgagcaaagcttgcaacgtctttttcaaacgatgcggtgcttcatagaagataagtgcttcaggcttttgtgccaacgtcgttacggcttccgttaactccttgcctttacgaggcaaaaaaccgtagaacgtaaacggttgtggtgtgatgcccgaagcaatcaacgctgtaatcccggcattggctccaggtaatggcaccactgaaatgcccgcttcaatacaagctttaacgagctcatgaccgggatcactaatcgatggcatccccgcatcactaacttgcgcaatatcgtcaccggcttctaatttttcaatcagcgtttcaatccgttgttgcgtattgtgttcgtggaaactaatttgtttcgtttcaatctcaaagtggttcaataacttctgcgtattccgtgtatcttcagcagcaatcagtgcgaccgatttcaatgtatcgattgcccggtaggtcatatcgcctaagttaccgatgggggttggtactaaaaataaagttcccgtttccgtcgttttaaaacttgattgtgtttgcatgttctatcctttcaagatgcatcaataatgacataaagacaggccaaaagtaagcatcccttttgccctgccttttttaatcgtttgttcgttcgccgtagatgacatcattacaaaatgcgcaaggctcgttattttcgcgtcgtgacccataaaaatacgggcagatatggaagccttcttcgtaaagattctgtaagttttgttttgatttcgaaagggcttgagccccttccttacccgtttgcggggtggctgatggttccaattcttgcaaatgttcccgcaagtgcttgttttcaatctttaattcagcgtttttctcaaggacttcggcaaggactgctttcatttcactgagcccctcaaacgtcaatttagcttgctgttcaatgtctgataactgttcatataagtctttactcaccgttgatatcctcccgatacgctggttatgcgttttactatgcaattaactttaacgttaaactctctaagacgttttggcaactaatattttgttcaaaaatgcgttgtgcttgtaaagcatattccgtctgagcgaccaactgcgtggtagtcaacgcggcgctggcctgatttaactgactttcgtacgcaccaaaacaaggtgtggcacctaattcatagcggtaattcaataaatcttgataccataagcccaccaaagttaaaaaggtcttctgctgttggcgatcaactaataatggtaaaatttgcgtctgaatctgcacaaatgcttctaaatcacgttgttcaactttttgtgcccacgcggcaagcttcgcactgacttgtaatagccaatcatccgccaataaggtctgtgcttcagctaagtcactcgtcaaatgcaccaataactgcgcttgttgtggcaaaataccagctgcttcaaactgttgttgcaccatttgtggtgccaatgctgccagatcaatcacttgaagccgtgataaaatcgtggggagcatttgatttttattactcgtacataaaatcgcgtaaacattttgcgccggttcttccaagaacttcaacaaactattagccgcgctggcggttaacgtttcagcagcttcaatgatgaataagcgttgactggattccatcccgctcttagccacttcttgtttcaaatagcgaatatcggcaatcttaatactcttaccttccggcttaatttcaatgacatccggatgattatgcgtcaaaatccgctgacattccgggcatgcccgacaaggttgcccatctggtgtcacttgttgacagaacagacgcagtgccaaccactgtgccaattgtgtcttccccaatccctgtgcaccagctaatagataaccatgcgccatctgtccacgcgcgataatctgggcaaactgggccacaagtttgggttgaatctgttcaattgttaaactggccatcgattagaagcggtggaactgttcaatcggcatcacaaagacggttgccccaccgacttgcacttcaatcggatatgacattgagctatccatcgtggcatccatattaacaggcggtgtcatgaattgttcgcgtgcctgacacgttttttcaataatcttaagcgcttcaggaacccgttcgtcttcaattccgacaataaacgttgtattcccaaattttaagaagccaccagtcgttgacaacttggttgcccgaatgttggcatcgattaattcgctgcttaataagttgctatctttatcttgaacaattgctaaaagtaatttcatttcaatctccccttttctatgctgtgaataagtctggatatcgttgttcaatcacttgcagacatttggcaacaactgtgtctatatctgcggtcgcatcaatcgtttgaatccgctctggattatcttgcgcaagttgtaagtaggattgccgaactttttggtgaaaagccaacttctcttggtccaatcgatcatattgatcctgtcgattctgtttaatccgttgtaaaccgacttcagatggtacatcaaggtataccgttaaatcgggtactaatccgttagtggcaaataagttcatttgcgcaacggcttcctcaccgatgccacgacctgccccttgataagcgattgaactatccacaaatcgatcacaaatcacgattttgttatcagccaacgctggttcaatcttttcaacaatgtgttgtcgccgagcggcagcgtataacagtgcttcggtgcggtcatccattgccgtattttcaacatctaaaatgacattgcgaatcttttcggcaatcggattgccacctggttcgcgcgtaacaatgatgtcttggttgcacttggcttcaagtagcggtacaacagccatcaacgcacttgtcttaccagcaccatccggcccttcaaacgtaattaattttcctaccacaaaacaaccttcttcatccatagagttacttccattttacttgattcaacaaaagacgtaaagggaagagtgcgtatcaggcggttatgttcttgcgtttagcgtgcgacagcagacgtttgaaacaaaaaaagacaaagtcactcgaccttgtcttcacgctgcggctgtcatctgaatacccgcgctatctaaatgtatttctggttgctgcttctttcgaaactgcttcgcctgctactttacgttggcgggcttggcggaataagaattcaaactttgtttgttgaatcttactttccatctctaattggtcatcgagtccgcggacgttgtcttgcgtcttttgggccatctgccacttatctttgacttggtacactaaatccaataaggcttgatcacctaattgttttaatgtcggtttttttctaccaaacatcgcaaacccaccattcttaaatttcttgacgcccttcaaccgcttttaacaacgtcatttcatctgcgtattcaatatcgctaccgactgataaaccgtgcgccaaacgcgtcactttaatcccagctggtttaatcaaccgcgaaatatacattgccgttgcttccccttcaggtgttgcattagtagcaatgataacttctttagccggtgttttttgcaatcgtttaatcaaattggcgatgttaatatcatcgggccccttgccttcaatcggtgataacaccccatgcaagacatgatagagcccatgataatcattcatccgttccatcgacatgacatctttcggttgttcaaccactaagatcatgtcctgactccgcgttgtatcgcgacaaatttcgcacggatcttcatccgtaatgttgccacagacactacaataatgcagatcacgacgtgccgaaattaagttcttggcgaaattcgtcacatcgtcttcattcatatcaatcgtgtaaaaagctaatcgggttgcggtcttgttcccaatcccaggtaacttcatgtagctttcgatcagcttcgcaattggttctggatattgcatcaatgcacttccttaatgtctcacttaaaatgggaggcctttagtaaatttacccatttgggcttgtgtttgtttatcgatttcagtcatcgcttcgttagttgccatgataatgagatcttgtaacatatcaacatcatctggatcgatggcctctggtttaatggcaatgtctttcatcttcttgtcgccagtcattgtgaccacgactaaatcattggctgctttgctgacaaattctgtattgttgagggcttcttgtgtttgccccatttctttttgcatcttttgcatttgtttcatcataccttgcatattacccattccgcgcatcttcattacttcctttcaaatttaaacgttaatcttttttaacaaccaccgcatcgccaaacaaagcttgtgcttgttcgacaacggccggtttttgttctggtttcggcgttgcttctgcttcgtcatcagttgttacctgttgacttggtactgcgtgattctgtaaatattcctggcgaatttctggccaaacatcgtggggcactaaaaccaccttgaaggggttgccagtcaaacgattcaagccgttttctaaaatgttcaaaagatcttgatcattgctagctcgctcgaataaaatcgcgtagttaaacgcgacgacaacgccactttgactcgccgcaaccggttcggaaaccttcatcacggcgcgcttggtaacgtccaacatattcaacagatccggccagacttctttgagattctccaaattggtccgcgtagcatctgccaataccggataaatcgccttacggttgacctttttactaatcttcttagcaggtttggcctttggcttggcagctggtgcactcactggtcccgccgcttccaatttttgtaacgccgcttgtaattgtgcaacttgttgactcaacgctgcgacttgttcattatcagcagctggtgcggcaaccatcgtagtcgttacttgggctgtctggacttgcgtcaagcggaccgttgcgacttccagatagatttctggatggttcgtgaaacgcaattgctgttgcgtttcattcaggatatcaatcaccccgtacaaacggtcagccggcatcgctgcactgagcgctttgaagtgttcatccaatagatccatttcacttgcggcgactaattcgggtgcttgttgatacaacagtaagtcgcgcgcatattcaattaagtcttccacaaaacgttgggcatctttaccttcagccaaaatctgttgcaacaattgcaacgcttgtttaggcgcattatcctgaattgtttggacataatccgccaacaacgcttcggttaagctgcctgtcacatccaacgcattatccaacgtgacgtgattgtcgctaaaggataacacttgatcgagaatacttaaagcatcccgcatcccaccttcagcagctttggcaatcactttcagagctgctggatcataggtcatttccttttgatctaaaatataagccattcgcttaaataaatcagcggccgtgatccgcttaaaattaaagcgttgcgtccgcgaaatgatggttgctggcaccttgtgaacttccgttgttgcgaggatgaataccacatttgttggtggttcttccaacgtcttcaacagtgcattgaacgcaccagtggataacatgtggacttcatcaatgatgtaaattttataatcagcttgggtcggcgcatatttggccttatcccgaatatcacgaatctcttcgaccccattattagacgccgcatcaatttcaatcacatcattgagggcgccagccgtaatggcccgacatgtctcacattcattacatggttcgccatctttttgataatgacagttaattgccttggcaaaaatcttggcagccgatgttttccctgttccacgtgggcctgtaaataaataagcatgacttgtttggtgcgtcataatggcatttttcaatgtttgggccattgtttcttgcccaatcacgtcatcgaaacgctgcgggcgccaaacccggtataaagcttgatagctcatttaatgacctccacctttgcaatttaaagtccgattcatttaaaactacttgttccattttagcatattttaccgtcaattttgattgcgttgcatgaaaaaagacccaaccgacaaaattaattgtccgttgggtctggttaattttcacaaaacttaagacacatgataaaacaaacttagtgctgctttcttccgaacctgacacgattcgtaggctcatcattgtctcaaggcctttcggcaattcctattctacctgattcaagcattaattaccagccattttcttttttttacggcgattttcgcgaatctttctaaaaaaagtctgcaataaactcgcacattcagcttctcgcaccccgccaaccacttcagcttggtgattgaaccgtttgtcagttaataaattcatcaacgtgccggtcacaccagccttaggatcactcgcgccaaaataaactttgggaatccggctattgataatcgcgcctgcacacattgggcatggttctaacgtgacataaatcgcggtatcttccagacgccaactcttttcaaccatacaggcttcttgaatcgcgagaatttcagcatgtaacgtcgcatcttgcgcgtgttcgcgaatgttatgcccccgtccaataatttgtccgtctttaacaatcacggcgccaatcggtacctcgccaataatgcgtgcttggttagcttcatcgatggcggcttgcatccattgatcgatctcttgttgtgtttcactcacgcgttagtcgcccctttattttacttctcaactattaaaacacagtcgcgctagtcgagcaattaaaaatggtgccgacggattgtcgataccatttttaattgctccataagccatcctcttccgtttaactgcaaaatgagcattatggcaaggactgccataatgctcatttcactgttaatgctcaaagcctgaccaactcgagtcgcactctatagtttttctttcacctttgttgcgtaagccattagtgtttggcgcaaatcatccatcatatctggtagattgtctgcgtgttctccgagcttatcttttaattgggttaacctgtctgccgcagtcaacaagttattcacatccgcatcggagagttgatcgaccaactctaacgccttttgattaccatgtaatttgtcttttacaaaacttttaactgctaatcgtttgcgatagcgcgatactttatcgattactgccttagaaccgacaaaagcggtcgttgcgccaactgctgcagtcacccctacgccgattaaaattttatatctggttttcatcgtatcaacctccttgtactttaatcatagtttagcacaattcgcctgaatttaccgctttcaaccccggtccttactttaatttaatactttggagaatgtaataccccttatccttatgaataatttgcacgttgccaaaaatgctcatcatcgttttcttcgctgatggggcaccttgtttcttttggatcacaacgttcaattcaccatctggtaataagtgatcataggcaccagtcaaaatattttgcaccacatcttttcccgctctgattggtgggttggtgaacatggcggcgtattgatccgttacgttttgatattcagctgattcgaatacagtaacgttggtaatctgattcaattcactgttcttacgtgccaaatccaatgcccgttcattcacatcgaccatgtcgattcggcgctctggtgcgagcttagcaatcgtcatcccgattggcccgtatccacaccccatatcaagcactggaccagctggcgcttcactcagatcgaccgctgctagcaatgcccgtgaaccgtaatcaacagtgcttttagagaataccccgttatccgttgtaaatttaaaattaaagccgcgtaattcaaacgtccattgccgctcagcgtgttcaacgtctggatttttagaatagtaatactctgtcatcttttttcctcatttgtcgttagttatctgaaaatttcccaatttgaactgacttcatcaaacgacctagcaagccaccaggatgcggttgatccgcaacccgttgattaacgaccattaaaacttgaaccatcgtgaaaattaatgaggtccgtttttgataagcgatatatttcgaacgccattccgtcgtatatttcttcttataggtccgtaatccctggaatccgtagaagtgatagccgtattcatagatcagatgagcgattcgttcttcaataaagctaaactcggaagtccctacatttgcaagaggcgccatgccgaggttgaagtacgtgtagccatccgttcgattttgttcaaagagattaataaagatctcatccattataccagatggcgcgtcttgtctgtgacgcattagatcaatacttgcgacttctttggttcctgttggcatttcgttagcgaaagcaattaattggtgatcggcattatagacaactgcaattggggctttttggaggtatgcttcatcgaaaaagcctaacgagaagcctttttcaacgcgactacccaaccaatcatcagaaaccgctttgagttctgccattaattcggcactaaatggtgggtttaaaatttcaaattgatagccttcacgttcaaacttattcattaaggcgcgttcagcccgccgtttcttaccagtcatcgtgaagtccgccaaacggacgtagccttcttcaccaaacttgataaagtcaaacccgatttcatgcagttgcatcgttaattcacttgaaatttcgtagaacgctaaatgacaatcaatcaaatcagcgtcgtgcatcatctgttcaattgccggtaaaattttagccggattccccaccggttcacccattacaattaagcgatccgcttttttacgataaagcaagaatacctgatcttctccttcttcctgatagaaataaactgatttatcccgtaagtatgccaaatgactgacctcattgccgccgtaagtgttaatcacgttagcaattcgtgcttcatcatatggcgctgctattgaacggccccctcgactgagataacggtagacgagatataaggtccctgcggcaaccaacatcccgataaaaccagccaaccagactctttcggatggaaataaaagcgctgttggtacgggtttgcgatgccgtaagtgtggcgaattggcaatcccaacaaagccgtataacaagaaggcgcccacgaaaagtacaccatccacaatccgatcattccatgaaaattcgatccgttcacggtataattcgcgtttcaataagaaactagctacgagcacaaaagttaaaaagacagcgagtttgattgagaaatcccgccatagtgtattggtaatcgcaaccaccaatagcaccatcaacggccagaaaactttttgaacgcggttggcaacgccgcgggctaaggccaacatgacaaacgctacaatgatgtttgtcacacgatctaagaagaagaacgtgtatgggtagagctgtccaatcactgtgttggtaatcgcaaagttcgggacagttgctactaataatagaatgatgcttgaaatataaaggaagaaaacaatgaagtgatgagcgattttttgcatcacctgccgaggtaagccctgtaaataatgatttaaccggctgcctgcatcgtgagtaaataaaccaacgccgactaaaaacggcacgatgtaataaaagacccggtaaaatgacaaccagacaacggcgtccgcattttgaacgccgactgcactcagaccaaagatcatgaataaatcaaacgttcctaagccccctggtaccatcgaaataacaccaatgatgttggcaatcatgaaaagtggtaagacttgtaataagtcacccttaatctctaagaaataaccaatcgttaagaaaaagccgcccgcaaaaccccattctaagaaagaccctaatgacaaaactgggttgtaaaagtccgattgaatatcgaatttttacaacccagaaagctgcttaaagtttcgtccaatatttggggttcacttcacgtcagattaaatctgacggttctttttttacataattggggcaaacaaacgcgctaagttctgtgaccaacgttcttgattgctttgctcttgtatccgttgtttcgtaaatggtaagcattcttttaaatcagccgtaaaagattgttcaagttcagttgcgagttgtgcatcatataaaaaagcggtcgtttcaaaattcaatctaaaactgcgaatatctaaattagccgtcccaaccgctgctagttgcccatcaactaacattacgcgtgatttaaatccggttgattcagagaagtaaatctgaccgcccgccttcacgatttgtctagcgtaatacaaactcgcatgatgaatcattttatgttttgcacgtttggccatcatgatcttcacagtcaccccagaattaatggctaacactaacgccgccaatacagaatcatccggaataaaatatggggtctgaatccacagccgttttttagcggcagcaatcatcttcaaaaagcctaacttaatctcatcgagttctcgatcaggtccacttgataccagttgcatgctagtctgcccgtgttcatctgagttaggaaaatattgcggactgtaatacaccttttcctgacgcgtagccgcattccagtccatgaaaaagcgagcttgaaacgataacacaccatcgccggtaatccgaatccgcgtatctcgtgcaggaatattaacgtgatgattattctggttaaaatcgccaaggtaggcggtattgccatcaattactgccaattgccggtggttacgaaagttaaagcgtagattaacgaaccggaaccgagaactaaaaaacgggacaacttggccgccggctgcttccaatggcttaaagaactgccgggataaatgttgcgacccaaatgcatcatacatcacacgcacttttaccccccgcagtgccttgtaagccaatagattgaccagttgacgcccgtgttcgttgtcataaaaagcatagtattcaagatggatatgatcttgcgcccgattgacatccgttaacaactgttgatacgccgccttcaaatccgttaaaattgttacattgttttcctgggtcacaaccgcggtatttgatactaagaagaggttgattaagctctgcgtttctggcggtaacgtgtgttgcttctgcgcttggcgtaacgctgctttttgggaggtcaccaaggcatcaatgccgagccgttcttgtgtttttaaatcgaccatatgatcttccggtaatttttttccgaaaaatagatacaaaacaaagccgataattggtaagaaaatcaataccaagagccaggcccaggttgctgcaatatcacgttgttggcgaaatacggtgataacagccccgattgtatttgcaatccaaatcagtgctatcccccagataatgattgctgtcattcttcattcatcctattctttaaaccactttgcttttaatttggctagcgtaccatttgcttgtaagacccgataacgtcggttgataaattgacgtaattgttgatcttgcggacgcatcccaacagcaaactgttctgctgcaaaaggactgtcgatggcttgaaaatcgctgccgttgtggcgtgacttaatttcaaattgcgcgtagacttcatcaattaagagccccttaatccgatcggcctgtaagtcgataaacgcattgttataagtatcatataggattggtgcatggttggcaattctttgctgtaatcgtttaggataacgctctagttgttccatcccagatgagcccgtttgaacgcctaatggttggttggttaaatcagccatttgattaacagggtgtttcttgagcgacacaatcatttgccgattagtcagatacgggtcactaaacgcaacccgttttgcccgttgcgccgttttagaataaccactccaaattaaatcaatcgtttgattattcaattccgtttctttcatatcccaatcaatcgactgaaagtcaacccgaatgccactccccttaaaaatcgcccgtgccaaatcaacatcaaaaccggttaattgaccattcttctcacggtaagtcattggcacaaaactatcatcaatcccgacgactattttttggcgtttttgaatcgttgcccattgatcagcctgctgattgcgttgtgcgcaccctgctaaaccaatcatgatcatcaataaagccgctattaatgctgtttttttaagcttcatcattttgttgaaccccgtttggttgtaattcaaagatttgatcagcaatctggttggcaaattgaatatcatgggtgacaacaatttgtgtcattccctgctgtttcaaatctaaaatgagttgtgcgacacttgccactaacgatggatcaagtgcgctggttggttcgtcataacagagaatctccggttgcatcgccaatgcgcgggcaattgcgactcgttgacgttgaccgcctgatagttggaacggataagccgtcgcctgagcacttaaccctagttgctgtaataattttgcgccatctgctttagcctttttagcgggttgttttttgaccatgatgggtgccagcgtcacattctcaaggacagaaagatgtgggaataaccgaaaatcttggaagacaacgccaatgcgcgccccttgttcccgattactaggttcgtaaggtttaccatcaataataaaccgtccgctatcgggttgatcaagcccactcattaaccgtaataaagttgatttgccagcaccacttggaccgacaatcgctaaaatactccctgattcaactgataaatttaagtcgttcaaaatttgccgacctttgaaggattgattgatattttctaattgaaacatgttgccgcctccttagcgataataacgataatagcgttccaaacgccgtaatgcccatgtacaaatggctgttaacaataaataaataatcccgactagcaaaagtggtaagagattgacatcacgcgcacttgcgacattgccagcccgcagtaaatccccaatgccgataacatacactaacgatgaatctttaatcaagttgatcacttcgttaccgacagacggtaagacaattttaaccgtttggggcacgataattttagcgattgtttgtgggtaagttaagcctaagacctcagctgcttcgatctgaccattatcaacggcttgaaagccgccccggaaaatttcggcaaaatacgcagcataattcaaaataaaagcgattaaagcagcatcgaaccggttaaaaacaattccgaccacgggtaaaccataaaatacaaaaattagttgtaataataacggtgtcccacgcatcagccacacatataaatctaaaagataatgcagtggtttaaacttagctaataaccctaaacttaataataaaccaagtggaatcgcgccaataatcgttaggccaaaaacagccaacgtcatctgcgccccacttaataatgctggtaaaatcgataaactatagtcaatcatgacagactcctctcatttgtccaaaataaaaagccctctttgcgtttaaaacacaaagagggctaaatttcgcggtgccacctcaaatttttgtttgcctcacaacaaacaactcagttagttttagaccaataaaaaaagtcccctggatttctccaagaggacgaatttatcgcggtgccacctcagtttaataaactgctcacgcagcttaaacttatgtagtttctaaaactacagcgataacgggctaacggatcatctttattcgatgatcaaactcacggttgtgccattaatctcaagggccgacttccaccacgcatcagctctctgaacctcaagaattaatttggaccgttcaacgtttaatgtattgttattcattctattcaatattgcatcaaaagtcaatggttaatgtttattgcttaccgaaaagacgggcccagaaaccaaccttgtgttgtttcaaagtcatcaatggaactgtttcgcctagtaaacgacgggcaatattccgatagccttggcttgctgggtttttcggatccatcacaattggttcgccggcattggacgtcttgataaccgcatcatcatcaaaaataatgcctaacaatgaaattgaaagatgtttggtaatttcatcaacatccatcgtttcgccttcattcatcatatgacgccgaatccggttaattactaagcgtggcgcaatccgcatttcttcttcttctagcaagccgacaacacggtcagcatcactaacagaagaaatttcgggagttgcaaccacaattgcaccgtctgcaccggcaatcgcatttttaaagccagattcaatcccagcaggacaatcaagaatcacaaaatcgaattcttcttttaattcattcacgatggcggtgacttcatcaggcgttaacgcttctttatccgcattttgagcggctggcaataagtaaattttttcatcaaaacgtttatctttaatcagtgcttggtgcaacttagcacggccttgggcgacatccacgatatcataaataatgcggttgctcaatcctaagacaacatctaaattacgcagaccaatgtctaaatctaacaagcaaaccttcttatctaaaagcgcaagcgccgtcccaatattggcgcttgatgttgttttaccaacgccgcctttaccggatgtaataaccaaagctgttcccatttttattgctccttcattttacgatataattttggattaatctgtttcaaatccgttaactcaccgtagtcgataacatgtaaatcattgatgaaacttacactctgtgccgtaaatggcgtcttcttgtgatcgagaatctcaactgcgtctgctatccgcaattgtaacgcgtgtgataaatcacctgcaacaactgcttctgcattatctggaaaaccagcgtgcacaatcccggcaacttcaccaagtacgaagatactgcccgttgcttttaacgttgcgccttggtgtaaattaccgacgaataagacatcgccaacataattgacctcttggccgcttcgtaaaacattgggttcaacgtgaatactattttcccgccgatcaatctcagcctgttcaatcgtcatgacttccgattgaatgcttgtcccattaaattctggaaactgctcaaagacggtcgccagtgcttgcttttgcgcatcattcaacaagcgtctaccagtggtcagctccagttcaatctgatcgctccccaactgcggttgctctaagcgaatcttattcaataattccgctagtgcaactaatgcttgatcaaaatccgcacccgcatcaatgtttaattcaaaaccttctttgcgtcctcgtaacgtgactgcatccatagaaaaatcaaaccccttaccgttctgattttaattttagcaataaatattttaaaggcaaatacaaaaagacaaaataaaccaaatttaatgcaattgtcggtgctaaaacattactaataaattcgactggtgttactgttgcataaccaatcaagcgattcatgatgtaaatcgtactctcgagtaatgttaaacacaagacatcgattagcccaatgaaaaaggctgagtcaggtaaatattgttttaaataacgcactgtatagataatgagcggcactgcaaaagtgtacatcccgatcatccccgtataatacaaatcgtataaaagaccaatccctgctgcataccacgtaagttggcgttcctctggtaaaacaaaggccgttaccactaacacgagcataaatagccggctaatcaacgtatgatctggtgtatataaccattgttcacataaatgactgatggcgccatccaaataaaacgcaacgagtaagtagattggtaataaatagcgccgttgtaatcgcgtcacacccatgctactcaccttcaatcgttcgtttgatgacagtcacaacggttaaattgtttaaatcagcagctggggtcacataaacagttaatgctaacccaaaatcgtctttcttaactgctgctaccttaccaaggtacaagcctttaggggttaatccacctaaaccagacgtgattactttgtcacctttttcgattgccgcatcggtcttaatctgcccgagcttcaattgtttccggtcagcattgtaaccggacatgatcccattaacttgcttaccatctttggtattcaccacagcagcaaatccgttactactttgatccgtacttgaaacgagttcaaccttcgaattagtcttattgacttcaacaatccgtccaataatcccagactcagacatgacgggcatatcttttttaagtccagctaaggctcctttattgataaccaatgcattttgccaattatcaggattccgggataaaacagacgcattaatggttgtataatccgtcaaggtgccttttaagccaagttcctttttcaaacttgtattttcttctttgagggtttgggtttgaacctttgtttgagctaaatcatcaagttgtgctttaagttctttgttttcctggtacgtattaatcaagtctgttaaggcatctacccctcgaccaatcccattggccggcacgctaatgacttggttagtgatgcccgttacgtcgttgccaaattggcgtacgaaactcggactctttttgttattgcgtaaaccaactgacattgcgatgaagcccatgcagacgattagcatgattaataacacaattaacttcttatttgaaaaaaacttttgcatggtttcttcgccaccatccatccttaatatcgtaaaggtgggacaaaaaccggtgatcagtagtccttcctatagcaatcgattcacaacccgaatctgtcactaatttaggcgctacgtcaacgctgaccgcttcttgtcccacttctactgaacgattaatttttcttcataacatcgatattctttaatgattcgccagttccgactgcaacacagtctaaaggatcttgagcgataaagactggcactttagtagcatctgaaatcacttctggtaagtgtttcaacaatgcgccgccaccagttaagacaatcccgtgatcaatcacgtcggctgcaatttctggtgatgtttcttcaagtgtttctttgatggcttcgataatggctgtgacaacttctttgatggcttcagcaatatcaacagcttgaatgtccactgtcttaggtagcccagttactaaatcgcgaccacgaatgctcatcgcttcaatttccttagcgcgttctggtgatgctgaagcgatttggaatttgatttgttcggctgttctttcaccaatcaacaagttattgttttgacggatgtaagaaatgatcgcgtcatctaacttgtcgccagccattcgaattgaacggcttgaaacaatcccacctaatgagattgtggcaacgtctgttgtcccgccaccgatatcaacgaccatgctaccagttggatccatcacaggaagaccggcaccaattgcagctgcaaatggttcttcaatgacgtatgcatcacgagcgcctgccaccttagttgcatcaattacagcacgtttttcaacttcagtcacaccacttggtacgcagaccattacaaatggcttgctagatgagcgacctaatgatttttcgataaaatatttaagcatggcagcagtagtatcgtaatctgcgatcacgccatctttcattgggcgaattgccacaatactaccaggtgtccggccgatcatgtcgcgggcttctgagccaacagcaatcacgtcaccagtttgtgtatttttagcgacaacagagggttctctcaagacaatgtctttaccgtccatgtatacgagtgtgtttgcggtacctaagtcaataccgatatttctagtccctaatccgaacactatttttctctccttcagttaccaaacgtttttatagtcattggcattatatcataattttacgtaataaaaaacgcaatgtaactactatgttaacggattttcagaaaatttgacaggtctcgcctaaaattaacagattcttaaagaaaaaagcgttctcttttactccactaagtaaccctcttctcgcaaactgagatactgctggcttccaataatcaagtggtctaggcatacaatgcccatcagttcaccacaggcgacaattcgtttagtgaaggcaatatcttgcgttgacggcgtcaactggccgcttggatgattatgcaccaaaataaattttgctgcagaataacggaccgctaatttaaagacttcccgcggatgcgcaactgaactatcgagtgtgccaatataaatctgtttcatctgaataatttgatttttaacgtctaaaaaaacagctagcagttgttcttgcgtttcgcccgctagtgtttcaatcatgcgacggccaaccatttggctcgatgcgaccacaccaaatcggagagttcgttgcgtttgcaatcggtgactcaattcacagatggcttggatttcaatcgctttgactggtccaattcctgccagtgtttccaactgcgttaaacttgcttgttctaaatcccgaaagtcaggataatgcgctagcaatttgcgcgccacctcaccaacagataggtgactattaccagaacgcaaaatgacgattgccaattgctcgttcgataaacttgctgcgccgtactgcattaattgttctcttggttgtaattgtcctgtattccccgccattgtttgcctcccacaaaaaaagacgcatgacgcgtcttcttggtttaactaacaatacgttaattaacgggcctatttttctaaatacggaatcacttgagccaaatccccaacggtcgcaagtgtttgctgattggttatcgcagttggtgcaattaaatcagggaccataatcaccggaatggcagctttactagcggccatcacaccattaggtgagtcttctaatactagggcactaggcgctggtaaggctaatctatccaacgcttttaaaaagatttcggggttcggtttgccgtgagtcacttcgtctcccgcaacaatttgactaaaccgtgattgtaggccagtactttgcataaagtcatcgaccatgctgcggaaattgctcgatgcaatcacccgactaatcccctgattatcacagtaatctagtaaatcgactaaccctggcttaattgcaacaccatctgcttcaacaaccgttgctacgttacggtatgaacgatcaataaattctgttgcggccgttgccgaacccagctttgctttaaaataattgcgtaaatacgtatcagtggtccctaagatggcatggtgatcttcaggtgtaaaatcaaagcccatttctttagcggcccgaatattggcttggtaataaatcttctccgaatcaaccaatagaccgtccatatcaaaaataattcctctagttgtcattgactattctcctttaaaatattggcgaatcgtactaattaaatatagcgaacccgttacgagtaatacatcatcagccgacacatccgctaataattcggttaatgcaaccggccagtccggttcaaatgtaatcgtctcatcaactgctgcatattgggccgctgttgccgcgcgtggattatcaggaaccgtagtcagcaccatccgcgtcgctatttttttgagctgtggtaacatctcatccagatttttatcaccaagcgctccgaataacaggtaaatgtcacgatttttaaattgatgccgcgttgtctgaaccaattgcgccaccccttccggattatgcgcaccatccaagataattaacggctcatcgttgattttttcgaagcgcccaggccagttaacccgttttaaagcacgtttgatgtctcgaacctctagtttttgttgcgtcaactgtaagtaacaccaaaatacttgtaatgcaaccgcggcgttttcaatttgataatcccccatcagcggaatctgtaattgtcgatacgttaccgcgtcattttggaaagttaactgttgcccccaagtaggtaacgttttgaccgcagcactcgaaaaatcacagccactaatggctaacgaactattcaaacgagttgccgtttcctcaaccaccgtcagtgcttcttttggtaattgaccaatcacgactggatgaccagccttaatgatcccggctttttgagtcgcaatttctgcaaatgtcttgcctaatagagcctgatgatcaagaccaatcgacgtaataactgatatcagcggcgtcaacacattagtcgagtcatacaaaccgccaattccgacttccacaacggcgacatcaacctgctgttgtttgaaatatagaaacatcattgctgtgatccattcaaactcggtcacttcaaattcggggtcagttgtttgaatctgggcaaccgttgtctgaatttgttgcgtaacagttactaaatcggcatcactgattggttcctgattgataacaattcgctcgttgaaccgcataataaacggcgatgtgtaacgaccgacttttaaacctaactcttcaatcaaacaactgaccattttgacaacggatcccttgccattagtgccagtcacatgaatgaattgttggttttcttgcggattaccgagacctgccaacaattgcgtcattcggttcaggttcgcttctttatgtaatctggggcgcgaatgaatatacgccaaagctgtttcgtaatctgtcactaacatcgccaatctcctttaacaaactgtctctattttagcatagattgcacgcgaatcgatgcttaaaaactggcgcacacaaaaagaccacctcagtttttaaggtggccttaacgtgcttttggttgcaacaacttccgcttaatctaaaaattccgttaatcctaaaacctgaattaacggaatttttgtattgatgctcagttgctacccgcaaccaatcacacttctttcactaacgtgctcctcgagcagccttttccggttaactgcaaaatgggcatcatggcaaaaaacgccacaatgcccattttactgttaatcctcaaagcctaaccagctcgagtcgcacttcttttttaacgtgttttcatcaacagcttcctgtgctttgctacacttatcaaatcggcgcttacagcgccaattcgctaagttaggcaaatgctcagaagctaaccgttgatgatgcacttatgcattttttaattctgctactcgtttttcgactgattggtattgttgttcgtagtctgcttgtttgtcgcgttcttcttggaccactttttctggtgcgcggtctgtgaagcccttgtttgacaacttgcctttagcacgtttgatttcaccgtctaaacgtttcaattcgccttctaaacgggcgatttcttcgtctaagtcgagcaattcagccaatggcacataaacttctgcaccactgataatggctgtcttcgccaatgctggtgctgttaaaccttcagcaatttcaagtgacttaggatgtacgaagcgttcgatgaagtcttggttttgtttgaagatcgtcattaatggcgcatcttgaatgttgaccaagacatcaattggcttgcttagtggtgcattggcttcggaacggatattccggacacttctaattagatcgattaacgcattcatttgcgttgttgcttctggatcgtctaattcagcgtgcacttctggataagccgcattgacgattgaatcgccagtatgtggcatactttgccagatttcttccgtgacaaatggcatcactgggtgtaatagacgcaatgtttggtctaaaacataagccaagttataacgtttattggcaatggctgcttggtcgtctccgtaaaggacttccttcgccatttcaatataccagtcacagaaatcgttccagataaagttatacaatgtccggcccgcttcaccaaattcgaagctttcataaagccgtgtaacatctgccaccgtttggttcaattggcttaagatccatttgtccgttaaatcaaggttagcggcatctggcatcttcgttggcgctggtgtgtcttcaaggttcatgatgacgaaacgacttgcgttccaaatcttattgatgaagttccaggcagcatccatcttcgtgtaactgaaacgaacatcttggcctggtgttgagccactcgttaagaaccaacgcaatgcatcggcaccgtatttttcaatgacttccattgggtcaatcccattaccaagtgatttactcatcttacggccttgttcatcgcggattaaaccgtgaatgaggacgtgttcgaatgggcgttgttctgtaaattcgagactttggaaaatcatccgtgagacccagaagaagatgatatcgtagccagttaccaacgtattggttgggaagtagcgtttgaagtcaggcgcttcagtgtttggccaacccattgttgaaaatggccataaggcactactgaaccatgtgtctaggacatcagaatcttgagtccagttttcgatatcttttggtgcttcttcgccgacatacatttcaccagtttgtttatggtaccaagctgggatttggtgcccccaccataattgacgcgaaataacccaatcatgaacgttttccatccattgtgtgaaggtattttcgaatcgttctggcacaaagttaaccttttgatcggttgcttggttcttcaaagccatttcagcaagtggcttcatcttaacaaaccattgcgttgaaagccgggcttcaacttgtacaccagtccgttcagaatgaccaacactatgtgtcattgggtcgactttaatcaaataaccttgttccttcaagtcagcaacaatcgctttacgtgcttcaaaacgatccatgccgttatacttgccggcactttcattcatgctggcatcttcgttcatgacattgatccgtggtaagtcatgccgattaccgacttcaaaatcgttagggtcgtgtgctggtgtaatcttcaaagcaccagtaccgaaatccttatcgacatagtgatcagcgataatcggaatttcacgattcattaatggtaatgtgaccgtcttgccaacaaggtccgcataccgttcatcatctggatgtacagcgatagcagtatcaccaggtaatgtttcaggacgtgttgtggcaatttcgatgctcccagaaccatccgtcaatggatagttaacatgatagaaggccccttcatcatcttgatgcaacacttcgatatctgataaagccgtccgtgcttttggatcccaattgatgatgtattcgccacgatagattaagcccttgttgtataaggtaacaaagactttacgaacagcgtctgataagccatcgtctaatgtgaaccgttcacgtgaataatcaagtgataagcccatcttagcccattgtgcgtggatggttgcggcatattcatctttccagtcccagacttgttcgatgaattttttacgacctaagtcataacgtgaaatcccttgttcagctaattttgcttccactttagcttgagttgcaatcccggcatgatccatccctggcaaccagagtacatcatacccttgcatccgtttttgccggattaacatatcttgtaaggtcgtatcccaggcatggcctaaatggagtttacccgtaacatttggcggtggaataacgattgaataaggtttggcatctggattggcatttggcttgaataaatcagcgtctaaccaatcttgataacgaccggcttcaacttgatttggatcatatttggttgacatttctttgtgatcagtcatcttgttcactcctttaaaatattgcgtttaatggcaaacaaaaaagcattcctcacaataggacgaatgctttttcgcggtaccacctaaattaggactagactagtccccaactcatgatttgttaacgaacgaaattgtccggttagccctacttaatttcaggttaacagctcacaagctaccgattaattggtcattggaagacgtctcagccatgcatcttctctctaaactagcccaatcttaatcgctcttgttcaacgcgttgttaatagtttagctgagtgaacgccaaaggtcaagcgtcaccggcgttcattctgaaaataaatcccgaatcttctccccaaaaaaatcctgagaacaacatactgttattctcaggatttttatagttttttgatttgtcaaattaagctagacaaaatgtcttcatccatgtaactcataaaaacttccaacggtgtttggtaatttaatgactttctgggaatattattccgcttgtgtgcaacagacgacacgaaagtctgatcaacttcgttgaaatccatttcttttggtaatccatcttttcgtaagagaccattagaattctcatttaaagctcgttgtgacggtgttccaggatcagcgaagtagatagagacatcatgctggttgcacgaagatttccagttagaaaattcctttccacaatcaaaggtaattgatttaaacaaattttttggaatggactgcagccattggtttaccgaagtttcgatatcctttgctttacgccctttgggtttcagagtgacaacagcttttgaaatgcattcaactaatgtaataacagcacttttatgatgaacgcctacaatcgtatctccttctaaatggccaaactcatctttaaaattaggataatctttttgtctttcagagatattccttttaaaagcttgttttcctcgtttttcttgatgaccatttggtttacgttttcctttcattggaagagttgtttgatcgaagagtccttgtttgaactgtctatataaggtgcgtactgaacaagcaataggtctttccgcacgaccaataatcacatctggtgtccacccttgagcaaccatcttttgaatgtattcttgttggtcatcgggtaaagcaataggacgtctaccgcagcgcttcttgttttctttgtattgtttaaagtaatcgagagctgtgtagcctttccttaggaaagtaacgatattatgaatggtctgacgtgaacggccaacataagtggcaatttttgaaacaggaaccttttgatgaaaataagcttctatcattacaagttcttcaatggtaatatgggtgtaggtcattcgtaatcactcctatgttttctttggtcggaaatacatcttgagtgtaccacgaatggcctttttaattgtctagcttaattttacaatcgacgtttacaatagttcagcaatgatttcttcgtcttgatttaagaattgatcgccagctttgatttctgtcactttaattccagcaagtgagcgttcaatcaaggcatccacatcgatgcgttgttcgtagaaccgggtcttatctaagttaggtcgggtcttcggtgctggtggtgcaaaaatggtacagcaatcttcgaatggcatgattgataattcgtacgtatcaatatccttcgcaatttcaatgatttcattcttatccattgtcgcaactggccgcacgattggcgttgttgtgacatcattgatagccatcatactttcaagtgtttgtgaggccacttgaccgacagattccccattaaaaatggctaaaccttggcgcttagcacggatttgatccgttaaacgcaacatcatccgccgttgaatggtcattaagtaaccttctggcacagaatgcttcacttcttcttgaatttccgtgaatgggacttcgataaacttaatcccaccaacgtatggcaccaatttcgccgttaattctttggccttattcaaggcattgtcgcttgtgtatggtgggctaaagaaatgcaccatttcaatgtcgacaccccgtttgagcgttaagtaacctgctactggtgaatcaatcccaccagataacatcaacattcctttaccggcagaaccgactggtaagccaccagccccttgaatcacttggttggttaagtaaatcgcatcttggcgaatttcaacccgcaaagtaatgtcaggttttttcatttgcacttctaattcaggtaattcatctgataagtaaccacctaattcgcggttcatatcattcgtatccaagaagaaattgtgatcagaacgacgtgtgttaactttgaaagacatcccaggtttgccgatttctttcatcatggcaagcgccatttctttaacagaatctaaatcacgatcaacttggatacttggtgagaagttttggatgccgaagacgtgacggagacgttcgataacgccttctgcatcgtcgccgtttaaaacgatatgcatccggtcacgtttagggtgaatccggagttgtttatactcgtgaagcgcctttgtgacgttcccgtttaaccgaccgataaaatcgttccggtttttaccctttgtcgaaagttcgccgtagcgaaccataatttcagtgtattgcatgcctatctccttttagatggtagtttacgaattaatttttttgaagcgttcgttaatttgatcgaacgctttgatgaatgcatccgcttcttctagcgtattgtattcatcgagggatacccgaatggcgcttgtcgcaattttttcattgacgtgcattgcctttaaggtactagattcagtccctttcttcgaagagcaagcacttgtcgttgaaatatagatttcgtgttcttcaaacgcatgaaccgttgtttcaccgcgaacacctttaattgcgaagcacaaaatatgcggcgcaaaatcaggcgtcagttgtgaaaacataaccgttttatccgattgactgatatggttaaagagtcggtctcgaatagctgcttggcggtgtactttttcagtctcatcggtcaataacaaacgtaaggctttggccattgccgcgatggctggcacattttcggttccagaacgtaaatcatgctcttggcccccaccggttaaaagcggcgctaaatgacgcccgcgtttcttatacaaaatcccagtcccccgtgggccgtggaatttatgccctgataaggtcacaaaatcaacgcgttcgttgaaaatcgcctcttgaatgcctttgccaatcccttgaacggcatcaacgtggaaatgaatattaggataatccttcaaaatatcagcaatggcttcaagtggctgacacgttccgatttcgttattaatggccatgatcgaaactaaaatggtatcaggccgcaatgctgcttttaagtcagccggatcaattcgaccaaactgatcaacgggtagataagtcacatcaaagcctaatttttccagttgctgcatggatttaatgatggctggatgttcaaccgatgtcgtaattaaatgtttcccaaacgcccgtttttcaattgccgtgccttttaagacccagttatcgccttctgttccaccgctggtaaagaagatttcatcgtggtctacgcctaataaatcagcgatttgttggcgtgattgttctaaaatatgaaaggctttttccccaatcacatgtaaactagaggggttgccgaagaactgttcactaaccgcttgataggtctgaagtgcgcctggcgcgattttagtggtggcactattgtcaaaataaatcatatcgatccttcttactaaaaattagtgttttaacgttgtacattatagcaaattggttattaaagacaaccaattaatctttaacaaaacaaatccgagacaaaatgcgtcttgtctcggactggtgagcatctaagtgactaattagttgcgtctgacttttggtcgtaataggccttttcaacttgtgtgtaagcacctggatcaaccttttcaagggccgttgccaataagtcgacagctttagcatagtcgtattcttcattaaaaatagtttggaccgtcacacaggcttcctggatggcgggaaaatctgcacgatatcggttggcatattgtaacaattgctccgtaatcaatgcactgtcaattaaggtatccgtcttggccttcaattcatctaaatcctcttgaacgagaattaattgcttcgcgatatcgtctaaattaatcttaatttgattcaaatcatgatcaagtttttgaatctcatcagaaacaacgaagaagaaatccaaatatttctgttgtaaaccaggtaaattaaccttttcaacagcgcgcttcaagttacgtagttcaagttcaaactggcgtaagttttcattagcgacgacttcgccttgatgcaaactagcaacctgatcatgaattgcttgttgtttttcttcgatgacagttagccgttcgtcaatcccggtcaaatcttcagcaatcgccgtgtaaaccgcttcgtggttggcaatcttcgcttggtgcccttcaactaacgcctgttcttcaccaatttgcttttgtaattgtttggcgcttgccaactcaccatgtgtgagtgcataactctgattgagatgatcgagttccaataatagctcatggttctgacgttcagcatgttgcacgaatgtcgcggtggttggcaattgcgtcgcgactgccttcttggcagtcatctcagcttctaattgatcatataattgatcaatgccacgtgcaatttcatcgttattggcttcaaccgactcaatggccaaatcacttaacaaggtagtgctcttatcaagttgatccattagttgttgttgtttgacttcaatctgccgatcatcaaattgataatgttcttttaacatttgatggtaggtatcattaatttcaaccagttgttcgggaaactcgttagctaattcgttatagcgctttggaatccgttccatctggtcttctaattgcgttgtttcagtaattaatttctgcaaaatggccttagcccctagatggtcgccggctgttgttagttcgttggcttcgtcaaaatccacctctaagcgacctaacgttgcttcaagcgcatctaatgcaggtccaaacgaaaaactcttagtcaacaaacgtttacgtagttgttgatattgttctcgtagacgctgaattttttgacgtgtatcggcttcattggcaagtagattttctaaagcatcttgaacatccagtaaatcttgatccgtttcagtcaagtacgcccgcaattgtttgagaatccgtgcaacctgaatgaattggtatttggcattggccgtttccgcatcaaaaagatagccttcaatcgtgctgaagttatggttggtaatctgctcatattgtttttcccaacgatcaaagttttgcaaactttcgcccgtcaaatgtaacgaccgtaacttcgttaagcgttccggaatcggcaacgccattaagtcgcctttatgtgcttctagttgtttaatttgtttgataaaataacgttgataaaaaacaacacttaggtagccaatcagtgcgacgactacgattccaatgagaatgtaaaacattcaaagacacacccttttacaatttaaatcagatttgttagtccgttcatccacttcaattcattaaactatgtttgattatagcatgaataagataacggttcagcaataattagcgataaactttagaaaagctgcaattttaatctgaatttgcttgacgttgccgcacaccgtacgctatactagccattgtgtaaaataatgcagcagtaaacggtaaagccgtcaacagttcatttgcccagagttttggttcaattgtgtaaccttgcggctgcaaaggtgaagattgttaataagtgaactgaacgattactaagtttacatcggattattttactccaaaacatttattggaggatttttttatgtcacgttatacaggtccaaagtggaaactttcacgtcgtttaggaatttcactatcaggcacaggtaaagaacttgctcgtcgcccttacgctccaggccaacacggtaacgaccgtcgcggtaagatttcagaatatggtatgcaattgagcgaaaaacaaaaacttcgtttaatgtatggtttaacagaacgccaattccggaacttatttgctcgcgctggtaaaatccgcgaaggcaagcatggtgttaacttgatgatcttgctagaacaacgtttagacaacattgtttatcgtttaggtttagcaagcactcgtgcacaagctcgtcaattagtaaaccatggtcacgtaactgtcgatggcaaacgtgttgatattccttcatacgaagtaaaacctggtcaagaaatttcaatccgtgaaaaatctaagaaccttgtaatcgttaaggatgcaatcgaaggcacagttggtcgcccttcattcgttagctttgatgctgacacaatgaaaggttcacttgttcgtttaccagaacgttcagaattagaaccagaaatcgacgaagccttaatcgttgaattctacaacagataagcagttatctgttcaattaaaagagtcagacttaggtctggctctttttttgcgcatttaaagacgcgtgcctacttagcacacgcgtctgatttaatctatttagtctgtaccaactcatataaaggcaccatcttcatcaaggtcgtttgaatatcggccatgagagcttcgggttggtcgaataatgggttgtctttcagataaacttttccgaggagccactccccttttttggtcttagcaaacttatcttgaatcagtttcaagttctccgatgacattgggaatttttgcttggtcatgtgatcgtagcttaaatcatagtcggcaaagtcccttaagaggctttctgtttggcttgccaataacggtgcgtaatccgtcttatctggcatctcagccattaaagcaaaccaaacgaagatccgatcatcccaaaaaccgacttcaaagtgcggtatcatcttatacccgcgtgagctctcactaagtgccatccaagtattcattggtggatttttgaagcggcgtaaatgcttggcaatatgcaacgagaattcgcgttttgtttctactacgagttctgcttgcaattgcacaccaaatacttcaaactttggatcaagttgcgtataaatcttgtctaaccggccctttaaggtttggtcatcaaaaatatcaaaatcagcacgtgtaaacatctttttcctccaacatggtatacttaggtttaattctaatatagcacaattcagaaatgaggcgactattttgtcagataatgatcaattacaacaacacttggatagtgccatgcacggcgcaccacaaaccaatcccgatgaacgccgccgctacctcggctcattacgtgaacgcgtcttcttaggcattactaaccaggaactcgccactgcgcaagctaaattcgaagcgcatcttacggattataagccctattccgtcttattaaacggcaagaaccccgctgctaccgattatttagcggccctttcagcacacgggattccgttcacgctcgttaacaacgaaacagccaaaaccgaaccaacggccttcggtttgttagtggttgccaaagacgcgattaaccatgaggcaattacgctcgatacactataccctgatccaaaaaccacaacgcaagatgcacccaccaaaaaaggtggtttcttaaaacatcttttcgattaacactaaaaaggcccgcacagtttaacttgtgcgggcctttttgcattactttagtcggtttcaatcgctaattctgggaaaagtaattgtaagacagtcattgaaacgcgccgcgcttggcccatcattgggaacaagtgcatcaacatcgctggattgtagtttgcttctagcacaaccgccatctcagggtgttccggatcatatggttggtataagtttggcacaatgatatcgattcccgtgatattgaggttcaaaatatcagcggcctgttcagcaatcgcaaagtaactttgatccatctcatcggtcacgtcaaccgaatcaccaccatttgagacgttggaattttgtagtaagaagacctgtgaaccacgcaatggcacatcttcagggcggtaaccttgttgtttcaacatgagcaactcccgttcactgaggcgaatgttttgcaacggtgtcaggtgcgcttcgccacgtaatgggttgtcgtttttcttagcaacaagttgggcgattgttgaacgaccatcccccacaacattggctggaatccgttctaaaacagcttggaccttatgattcatcactaagaaacggtattccgaacccgcaatgaattcttcaactaaaatttgctgatcgtacgtctgtgccagcttaaaagcagcaatgaagtccgcttcacttggacgcgttaaaaatgtggtaatgcccgcccccatgttactgtgttttggtttaatgacaatcgcgcgctgaccaaacgccgcttgataatctgcaactgccgtctctaaagcgatatattcggcacccgccggcacccgcatgccatgacttgccaataaaattttagtcactaccttattatccactaacggcccactaattagccgatctaaactcgttatattcccatttttgactaattcatgatgatgttgataggtcagctcaataaattgttcatcgcgatccaaaacagccacatgcagccctttttggaaagcgtcaaacatcagcatttgtgttgataattccatatccgtgtatccctgtaactgatagggagtctctgtcagctcacatttaaaacgttttgcctgtttgagggcaaatgcctttagcgagtcctcttcaatcgcttgtgttaagcgataactcaaggtttgtcgatggtcctgaacacgctcattcatcactgtccaagcttgtttaaaacgctcattcagatgataatccgtaatgaattgggccaaatcggccatcacagttttcaattgtgtttggagctgcgatggctgcagcggattctctaatgctactgtgtcatttaactgacgacccgtctgaatctgagtggctaaatcaccggataatttcggcaaggataataagtacataaagaataagtgtaagaagtctagctgttgttgatcaatccccgtcgcagtatacgggttaatatcaaacccccgaaattctaaataatccacaccagtctctaacatctgatccaatgagtgactccgtaaccgcacagttccgtaaaattcgcgttccgaaattaagtcgccattagcaatcgcttggcgcattgaatcaacatatgcggcaactgaatcaaaatgaattaataattgcttattgctgtagccgaataattcactcgagcgtaaactccgtacagggtgttctggtaatttcgtcatatcttctaaaaagcctggttccgctatcggactcgcaccaaataaatacgttaaaacatagtgataacgcacgtaattttgcgcaatctggatgtacaacgcatcgctaaaatcttttagactcacatagtgatcatgatagtattcatcaaataaacgcacaattaacgtcgatgacaggctaaaattataatggatgccagagaccatctgtagacgtcgaccgtagcgcttcgtcaaatagtcacgataggcttttaccgccggtgtgtattctgaaattggaatggttaattcatcgtctggtaacaacggtggcatgctgaggggccaaatatattccgaatcggccatacttgattgcaatacttgttcgagcgctaataattgttgttggacatctacggtctgttcgaaggtatccgtaaccagttccgtttgcatctctgcaaaatcagtcgcaatgtatggatgaaacgttcgcgatcctaactcactggggtgcggttgttgactcaatgcgcccaatccggtcactcgctgcccctctttttcgaccccaaaagcaccttggttcaataaaggtgttaagcgtaattgtttaatgttctcaaataattgattaggcattttgaaacctcttcttaattcagtcttatacaactcattatacacatccctaaaaccttttaaaacgataatcactacgaatttgcgcgacatgttatactaggaacaacctaaacattaaaggatgaacgctatgcaacaacctctcgcatttcgcatgcgtccgactaacatcgatgaagttgtcggtcagacgcacttagtggggccgcaaaaaatcattcgccgaatggttgatgccaaactcctctcatcaatgattctctacggaccgcctggtactggtaaaacgagtatcgctagtgccatcgccggtagtacccagtacgcttttcgcatgctgaatgctgccactgatagtaaaaaagatttacagattgtcgctgaagaagccaaaatgagtggcaccgtgattttactcctcgatgaaattcaccgcttggataaaaccaaacaggattttctcttaccacatctagaaagtggccgcattatcttaattggtgcaactaccgaaaatccatatatcagtatcaaccctgccattcggagtcgggcccaaatttttgaagtcaagcccctcactgaagccgacattcatgttgccattcaacgggcactgacagataaagaaaaaggcttaggtgcactagccatcaatctcgatgaaacggctgaacaataccttgcccgcgtcacaaacggtgatttacggagtgctttaaacgccctcgaactcgctgctcgttcaacaccagcgaatccagacaccaacgtcatcgacatcgatattgacgttattgaagaatgcgtgcagaaaaaagccattactcatgataaagatggcgatgcccattacgatgtcatctccgcctttcaaaaatcagtccgtggcagtgacgttgatgctgcgctccattatatgggccgtttgattgaagccggtgatttaatgtcgattagtcggcgcttgatgacaatggcctacgaagatatcggcctcgccaaccctcaagcctgtgcccgtacagtcgaggcaattgctgcggctaaacaacttggttttcccgaagcccggattccactggccgtagcagtgattgatctctgcttatctccaaaatcaaattcggccatcaccgcaattgataacgcgttagctgatattcgcgctggcaaagccggtgaagtccccgatcatctccgtgatgcccattatgcaggggctgaaaaacttggccacggtgtcgactacaaatatccccataattatcccaacgactgggtcgcgcaagattacctaccagataagctcttaggtagtcattattacgaagcaaaagcaactggtaaatacgagcaagtcctcaaacaacagctagaacgcttgcgccaagccagtccgcataagtgaacggttacaaaagtgttgtgttaacatcacgagcgtgctactataatagtaggatttctaaggtgtgcgcgtcttcccaccttatgttgaccgatcaagtaattcgttaatgggacggatgagttattagcgagtgtagactttttcgcgaaggaaccaagtctaataataatctgacccacctgcattttctagcgggctcaactatcgggaagcatctacggcaccactagatttcccaaagtccaacgactttgaccgggctaacgtttacgttggcccttttttgttgattattttaggaggttgcacattgattcaaatcgccataatcgtttttttaatcattatcgccctacttggtgcgattttatgttactaccaagacaagaagttcctactctttgatttaactgaaaaccggcatttaggtcgattgatgtacttttcagggattgcactcatcggtgtagcgatctgcggggctttgatttactggctattgccactagtctggacattggtgacgctcgttgctgccagtttaatcgccggcttagtcggccttagctttgcaactaacctttaagatttacttttggcactgaactaacgtataataaagatgtaaaattaaatgaggtgatgacaatgttacaacaatacaagcacattttggtcgcaatcgatggttcttatgaagctgaactcgctttccgtaaagcagttgaagttgcccttcggaataacggacaactccacttgattcacgttatcgatacccgcgccttccaaaatatctctagttttgattccgcaatggttgaacaagtcacagaaacagctaagaaaacaatggacgaatacatcgtgactgccaatgaacttggcttaaaagatgttgactatagcattgaatatggcgcaccaaagagtttaattgcccgcgaagtacccgaaaagaaaaatatcgatctcatcatgattggtgcaactggtttaaacgctgttgaacgtctcttgattggttctgtaacggaatacgttactcggaccgccgtttgcgacgtgctcgttgtgcggacagatttagataataaacacgcactcaacaagaaacgcagtagcattggtcacgaagaagcataaattagcaatcaaaaagccgggacgcttatgtcccggctttttttagtggttaaccacttattcagccaattgttgatcaacttgcacaataatctctggatgatgccggattaacgccaatgttttagcaaccgttaaatcccgtaaggcgttctctcgatgaagcgcatgttctgcacgaccaagaatgaaatacaatgcatcaagtaagtaaagactttgcttatcgattgcttcgtcaatcgcaagctgagcgtacttaatcgcaccttcataatccttcaattcaaaaagaattcccgctaagtgattataaatctgcaactcaacttggaaatcggccatagcaagtggatcagaattctccaacatttcaacggcttgttctgcataaatccgtacacgctctaaagcgcccttcatcaaataggacttgctaatgccgataatacatagaataccgtaaacatccgtctgagaaacaacgtattgattgaaggcacgattgaaaaagaaaagtgcatcgtccggtttattctccagcaataacttaatttgaccttggaaataataataccgtttgtaatcatctgctttgaccagttgatctgtgtagatctgctgaatcaaatcacgtgcttttttgaattcattggtaaataacaatgcttgcacacgactcaacaagacgtgtaattgatcatcttcttgcacaatcactgagtccaacgtaatttcaagccgcttacaaatttccaagagaatctttgtgcttggcacctgttcttttttctcaattaagctaattgttgcttgcgtacaaatccccttagctaactccgcttgagacatcccccgtgctttacggatttgttttagtttatcccctaatattctcattttaaatactccaattacatcattatttaatttaaaattaatttccggaaaatataacccaattaagtattttacatcaattagtaatgacgctactagttgcgtttattatacactatgaactagttatgtggcattgcttatttttttatccaataagtattttacactacatactaaacattaccaaacatttatctttaattaattgttaaggtgctgttcgatagtacgacaaaaaaacggcttcctgcagcggaagccgttttttataacgttgctaatattgccggaacttcttttaatgattcaatttgataatccgctgccgattgatcaatcgcgaaaagtggatcaaatggttttaatgcgatgacggttaaaccagccgccttccccgcttgaatccccagtgcagagtcttcaatcgcaaccgcctcggttggttctaaatgcattcttttaagcgcttctagatacacatctggtgctggtttattatgcgcaatctctgcaccactaacaaccgtttcaaaataaggttctaacgcggtttccaacaacatttgttgaataattccgcgctcaccagcggacgccaaaccgatttgatatgtcggtgcaacggttgctaataacggttgcgcgtctgggttcatgatatttttaaaaacgattggatgagccgctttatacgacgtatagccgtttttaattgccgctcgttccaaaacagtatggtttggaaacaactgttttaaaacggcattcatattggaaccaatttgtttacgactttcctctgccgttagtcgtgcgccaattgcattcaaaaacgctaagcgttgttcaaaataatacggttcactatccactaaaacgccatcgacgtcaaaaataatcccttttactgtcatcttctctcaatcctatctggttaattaaaataaatctgaaatcttccgtaagtaatccgcaattttatcaggtaattcaggttgtagcaacaatgactgtaaaaagcgattgcggttataccaccgattccaaaaaccaacggtctcctgtggtgccatagtcaacaatgaacgctgccactcctgtaagacgattaaacaataatcgacatagagttgatgcttgttcattaaactgattagaacgttcgtcagatgactatcttcaccatatgcgagtgcgttatcagagaagcgatacgcctgtagcacaattgccatcatcaaaatcttatccgcacgttggatttcaggtgtttcgttaagttctgaccagacattgatgatatgcgtcatcgcatgcgcccagcctttaccatcaacgtatcctcgtgaatctaattcgatgactgtataagccattactcgccgttcaattgccaataattcggccgtacttaatacatgataaaaagtgcggttagcatataaaatcccggccaaaaacatcgcgctaaacgaacgtaaaaaaacagcgtcattttcaggttctaaaatatgcgcgaataaataatcatcttgcaataagcggtccttgacccaaatcaattgggctggggttaaaaccgtctgccgtaataatcgattgaataagtaaaaaacacctttatcgcgcacttgcgaatctgggcttgcaagatgccttaataaatcatcgagctcttcatcgctgatggtcgcttctttgcctttggttttaattcgctcatcaattgctgtgattcgttgcaagactgactcgttgtcctcaggtactacgacatgtgtccgccgcgtcttatattggacgccatccatgacgaccaatactttttccggaattgattgatagatgtcccctttaatcaatgcactacgaatcgcgtctaactgttgcatcacattttgaacttccttcatcaatcatcacccactctctactgaaaacatctcataactaactattataatgcattcggccacagacataaactatcaatccttaaacaggcccacgatatgacaaaatcgtcacctcgcttagaataaattccacctttagactgaatcaatgtaacttctagcttgatacgattaagacatcaattcacaaggagtgtcaatcatgaaaaaaatcattctattactgttctcacttggactaattgttatcggcggtccaattatcggatcagccacaactcagaatatgacggacggcaatgaccttgcccaacagtgggaccggttcaacctcttaattcccagagaagccgtctatgttaaaacagcacaccaatacgggacacaacaagcacatggcgattacctttaccggcaacctgcttaccgtgctgatggcagtcattacgaagtcgttttccaagcgccgcgcgcactaaaacctaatcactacttaaaattagatgccaaggggcgcttcgtcaattcttggactgtcgtttcaaaatctgaattgcccgttaaactgcagtctagtctataattgtaaaatacaatcgaactaaatgctgttaattgcgaaatacaaacgagggatttcgcttttttcattgcttacatttaataagtatgctatattattcgcatgcactgataaaaacgatttcacaagggagtaatgaacatgacagaattattcgatttacaacaaacacgccggacaatttatgcacttggcaaaaacgtttcaatgagcgaagctgaattatcagaattaatcttcaacaccattaaagaaacaccaactgcttttaacgcccaaggttcacgcgccattattctctttggaaaagcaaatgaaacactttggaacgatattacagcaactgccttaaaaccattaacacctgcggaaaacttcccaagtacacaagctaaattggcttcattcgccgctggtgtcgggacaatcttgttctttgaagatcaagatgttgttaagaatcttcaagaaaacgtgccattatatgccgaaaacttcccaacatggtcagaacaagcttcaggcatggcacaatatgccacttggttagccctcgcagaaaaaaatgtgggcgctagcttgcaacattataacccagtaattgatgaagccgttactgcaaaatggaacattccatcaaactggaaacttcgtgcgcaaatgccatttggttcaatcgaaaatccagccgatgctaaagactacaataccgatgcaagtcgtttccaaacctacacaaactaattttaaaccgaatcgaccagagtgcgcatgcactctggttttttattttacccaacaaaaaaagcgactcgcatccgcgaaccgctttttactttaaggagaatgagagattcgaactctcgcgtgggcagaacccacctgacggttttcaagaccgttcccttcagccagacttgggtaattctccatatcaaatcttacaacgtttattataatatcaagttcgctaatcactgtcaagcctgttttttaaaaataactgctatttacacccgcccaccaactcggtatcataaaggggtgcatttaaaatcaagtaaaactacttggactggttcggaaacttcccagaataaaaaactaaggatctcaaggaggttagaaataaatgcaaactcgcaaaatcattatcgattgcgatccaggcatcgatgacacgctcgctttgaatttggccattcaatcgccagcggtggaagtcgttgcaatcaccattgtttgcggcaacgttcccgtccaaatcggcgtggacaatgcctttaagtgtcttgaacgcctcgggcggctcgacattcccgtttatgttggtgcggataaaccgctccataaaccatttgtcagtgcgcaggatacgcatggcatggatggtttaggtgacagccatatcccgcgcctatccactattcaaccggcacaacaatccgccgctgattttttagcagccacttttagtcaaccgagcgatatcagtattatcgcactcggaccattgaccaatattgcgactgcgctccagcggaatccagatttaggtcggcactgtgcccgctttgtttcaatgggtgggacctataagagtcacggtaactgctcacccgttgctgaattcaactactggagcgatccggatgccgcactgttggtattcgaccaactcgatcaaaagattgaaatggttggcttagacgtgacccgcgaaattgtcttcacgccaacattgctggcttattgtcagcgtgtcaatcctgaagtcggcgactatctaaaagccatcacccagttttattttgattttcattggcaatatgaacacattatcggctgtgtgatcaatgatccattagcagtcgcctattttatcgatccaaccctttgtcacggctttgaaagttataccaccgtcgaaacaaccggcatcagcattggccaaacactggttgaccggttcgatttctggcaccgtcctgccaatagcctcatcttaactaaggtggacaccaatcgtttctttgaacagtttttgaccgtcgttttaaatgcacaagcaaccctcattaaaacggacttaccaaaacttagataaggaacctattatgcgaaaatttaaaacacaacacttaaccattctggcacttgccattgcactcaattacgtaggcgctaacattgccctatttttacggttaccaatctatctcgatagcgtcggcaccattttagccagcaccctattaggtcctctggcaggcgcattaactgccacttgcagtagtatcatcagcggtgtcacgaccgacttatttgcgctttattacttgccagacggtctattaaccggcttactcgctggatggctcttataccaccaccaacggacgaaacgcgagttaccccttgttgctttaggtgtcgccattcccggcacaattgtcagttcattaattacttacttcttgttccacggtatcacctcttcagggtcaagtttaattgtacaactactaagcggcttgggactaaatcagtttgtcagcattacactggttcaagccggtacggattatctggaccggctcttggcaatcattgtggtgacacaggtttgcgtccacctcaaacaaaaaatcaagacactctaatcaattaaaaaaaagcaagtgtgcttctaacatcaattagaaacgcatttgctttttttagttttgcatcagtaacgtgacatactgttctagataatctcggtcgacctcatcgtaagcgccaacgacgcggttatcaagatccaaaacaccgattagttgattagccttgatcattggcacaacaatctcagaacgtgcagccgaatcacaagcgatataattctgatgttgcgccgtgtcttctacaattaacgttgtttgctttgcggcggcttcaccacacacccctttacctagtgcaatgtgcatacacgagacgtttccttgaaatgggcctaaaatcagctcagcatcttgatacagataataacccgcaaaaacagtctccggtaatatttgatttaataacgccgaagaatttgctagattagcaattaaattcgtttcacctgccagcaaagcagcttgttgttttaagagcatttcgtaagcctcgactttagcttcttttgatttaaacatcacaatcacttcctcttttcaagctattatagtggaagcttgctgcgttagcaattcaaaacatcccttaatttcgacattaaaaaaaccgcacatcggcggttttttttaatgaaaaattgttttatttcttcgataaactgtctctggttcgccctcttcatgattgacgtaccgcgcaatcgcgtataaataatcagagagccgattcaagaaagttaatacagcttcgttaatcggttctacttcctgcaaggcgacgacttggcgttcaacacgccgcgcaattgtccgacaatattgtagtttcgctgctgatggtactcccccaggtaaaataaattcttttaaagcaggtggaacatctgcatactgatcaatcttagcttctaaccatttcgtgtatgcgttgtctgtccgatacccccgcgaatcatccggcgtcgctaaatctgtcccacagtcaaacagaatttgttgaatctcaaccaattccattctcaatgccggataatcaggtaaatcactgatgacgacacctaagtatgaatttaactcatcaacacccccgtatgcttccacacgaattgcgtttttgcgcactttttgaccgccgataattctggttaatcccttgtcaccggtctttgtatatagtttcaatccgtagcctcctaaaactgtcatccattatcaattttagtgtaccacgtttgaaagcgaatttttggcgttacttaatttttaacacttgtctgcttgtatcaatttaagtaatgcctcaattcgacggtacgaaacatcacatgtatcgccatttgcaaatatcacttgatgcgtctccttatcaatccgtacgactttgtccggattcactaggatactcttatgggctctgaaaaattgtggcaattgcgcttgaatcgtcacgattttccctacaaattcacttaaccgatgatcactgtgtaagaagacgtgccgtgctttatacgctgtttcgaaataattaatctcttgaattgccactttttcaaacgataatccatcatcatattcaaaatgagctggttcttcagctaatggcacctgttgttgtcgtaacttaatggcacctgttgttgtcgtaacttaatggcatcgttaatggttgcttgaatatctgcacgaacctgtgctaacccgcgatccttcaaaataaaattcaaaacattaattcggcgttgaatggtttccattaaaagttcgtcatgtgttgaaacgaacacaatctgtgcatatggatccaattcacgaattttaagcgccaattccatcccatccagcacgtcattctctaaatcaatatcaagaaagtaaacgcccccttgcgtttgactttcttgtaaaaaaattaataggtcatagccattcttagtcttcaaacgcacctgagcatccaatatattttgttgaatatatgccgttataatctcttcataactatctagtaaaacctgtttatcatcacataaaaaaatatcaaccatgggtctcctcctgttcaacaacaagcattgcaacgaaatagtctccatcttgttttaacattaagctaaaatctgagcgcatatccgtgatttctttagcagttgtgagcccaagcccgcgattaatccccttcgttgaataaccagcctgataaagctgaccaaattctactggtgtattaatcgtatttttgacacaatagaccatcttacccttttgctcgaataaactgacactgattgaaccatctttaatatcatttaccgcgtcaattgcattatccaaaaagattcccagaatccgtaattcatcaaaatactgttgttgttgcttaaataaatccggttgaacctctaaattaaagggaatccgattattatgtgcttcaatatacttgctaaaaataatgcctttaatataagcattattaatctcttgaaaccgtccaattgcctgatcttgaatcgtgtcaaagttataatgcgttagtaaatcatgaaaatcctgcattaaaactgggctcccttgttcattgataattgtctctaaagccaataaagcattggcgatatcgtggcgaaacttgcgtatttcacggtagttacgctctaactgttcaacatacagcgttagatttcgctgactttcttgttctacgttgattctattttggcgaatcacagctttcgtatacaaaagcattcccacaatcaccaaaactaatagtaatagtacaagtcctaacacaaggtacaaatattcaaccggcagattcgcatgcttaaagctatcaaaaagcaccatcactgccaccacaaataacgcgagaccggctaaaatcgtgccggccacgcacataccgtatgaagcaatggatgctttaataagctgatctaaccgttggacaattaatcctaatccggctgcaatcaataattgactcaacataattaaacacaccatttgccaattaaactggctactcatcagattatcaaggccctttaagtgagtatacccaattaaccccaccgttgtcagaaccgatgatagcatcacgatgatgtaactaaagatggttgcgataattaacgcataacttgtctttaatttacgcagatttttaaagccatttaaccaaccatataatccaacagttgccaaaatcagccatagctcttcaagaaaatttccaattaataaatccattccctgaataaaagcaatgccgactccaactgataatagtagttgaaatctgttcgttcgtttcaacttccccgtcaaaaataatactaatagtagaaacgaactaaacgtacttagattaatgacaatctgcattgccagcggcattttcattgccatgcataaaactccctactcgaaccttaattccaaaaccagaaaattaaattttgaatgttactcatcattatcatacccctcctttcatattatgaatacccatgattggtgactcatttcgattttatcacgtaatttttttaaaaggattaaatgtcataaacgtatacttatctgcattaaacgtatataattaatcataaatatagataaataattactatttggaggctaaaaatgtttttaggccaattgatccatcaacagcgactcaacaagcaactgacacagtctgaattagcagcggggatttgcacgcaaaatacaatcagcaaaattgaaaagaaaaatctcccccccacaatcccaattctaattaagatttgtacacggcttggattaacattaaatgaacttttcaccgaatttaacgcgctcgacactgccagtgacgaaggcgtgatttctgcggaagttgctttattagcaggcgattctggccctgctgccgcattaattaccgatatcgacttcaaggcaaccgaacatccttatcccgccatcttcttctttttcaatggctatttaagttaccttgaccatcaatctgaattacagattttttccgcttataactcgttcacagcggccatcggtgacgacacttcaacgttgaagttacttctaaataccggtatgggtttaatttaccaagaagctggcgaggaattagctgatttttatttcaataataatatcaatttcatcaaccaacttgatcacatcaatgtcattgatgttcaacgcgtcctatttgcttcgcgtcacacagcagcctatatgattaaccaacaccgcattgatgcagctatcgagtttttgacgaaagccctcaaactgagtcaaaaaaatcaaatcatcaaacaagtcgatcatttgtattacctccgtgctcgggcgcgccaacaaagcggtcgagactatgcagaagatcgcgaaaccgcgttagtttttgccaaataccttaaaaataacgcgttaatcgctaaaattaaagcgttaaactaaaaaacactatccgattggatagtgtttttttaactaattggttgaacgcgactggcaatcatcaccactaagcaactcttgatcatttcaatcggaaaatacggcacaaaaccggtcattaagccggtcactacggataattttaatgaccagattagccagagtgtgccaaatccgagttgaataatgcttgctagcacattgccgccgagaagtacgcgattcgattgtccaaatagttgctgactatagtgaataattgccacataagcgataaaaccaatcagatagccgcctgttggtccgaccagcactgcagccccactggcataatttgcaaagaccggtaagccaagcatgcctagcatgagatagctcccgatgaccagtcgacttaagcgccatggtaacgtggtgccaattacaccgactgcgagcgtttggagtgttactggaaccagcgaaatcggtagactgacttgagcgctaaccattaataacgccaagcacatcccgactaagctaacttttctggcaaccgatagtgtcatttaaatcagctcctccttaaaatcaatcttttgggcgactgccacttgcgagtcatcgctcagaattaacgtgccatccgctaaaagctgtgtaatgacaagcccattttgcagacgtcggccaataatcgccgaccagttgcaataatgagcaccaatcgcctcgtccgcttgggccaatccggctgctagtcgattaagatacgtggcacaaaattgattgatgttcacttggtgggcgtttacggcttggcttacatccattatgaaactgccgctgccgtcctttttgaatatgtgcatgctttctacaataggaagagaattcatagttcactgggctaccagacccccttacaagttgaaattgcaacacttacgagccaaatggccgcctgatttaatgctttccagggttcaaataagttattaatcgcgattaatgatttatttgagctgtggaaggtaaacgcggttctgaatgtctcttaaaatctgtctcaaatattgacttcaatccatacctcctataatttttattttatcataccatttaatactgcatactagttaaatctctctaaaaatttctatccaaatggtgttacttttggtgttactttctacatgcacaaacaaaaaaagccagaaacgccttcaaataggcatttctagcttatgcaattcaattaccccacactgccttccatttcataactaatcaatcgattcaattccaccgcgtattccattgggagttccttggtgaatggttcgacgaagcccatgatgatcatttcggttgctttggcttccgagatgccacggctcatcagataatagagttgttcttcagaaattttagagactttggcttcatgttccattgaaacgttgccgtttagaattgtgttgtacggaatcgtatcagagctggagcggtcatccataataatcgtatcacattcgacatgggcaaacgaaccgtcactgtcgcgttcaaaacgaacagtcccgcggtaatcaacggccccgccatctttggcaatcgattttgaaacgattgaggatgacgtattcggtgcggcgtgaatcatccgcgcgccactgtcttggtcaacgccttcgccggcgacggcgattgaaagcattgtcccccgtgcaccttcaccatcgaggtagacacttgggtatttcatggtcatttttgaaccgagattcccgtcgacccattccattgtcgcattttccatggcttgggcccgtttagtttccaaactataaacgttctttgaccagttttgaatggtcgtgtaacggcaatagccatcccgtttcacaaagacttcaacgaccgctgcgtgcaagctatcacttgaatagcttggtgcagtacagccttcaacgtagttcacgctggcgccttcatcgacaataatcaatgtccgttcgaattgacctgaattttcggcgttaatccggaagtacgattggattggaatatccgtccgcacgccttttggaacgtagatgaacgtgccacctgaccaaacggccgagttaagcgctgagaatttattatcagttggtttgaccaacgtactgaagtattccttcacaatttcagggtattcgcgtaaaccggtatccatatcggtaaaaatgatcccaagtttttcgaattcttcacgcatgttgtgataaaccacttctgattcatattgcgcactggaacctgctaaatacttacgttcggcttcaggcacacctaagcgatcaaacgtttctttgattttgtcgggaacatcttcccaatcgcggtattgcttgtccgttgccttttgataatacaacatgtgttctaaatcaagatcggataagtccggtccgaaatctggcattggcattttttcataagcgtgaaatgattttaagcggaaatctaacatccattgtggttcctttttctcatgcgagatggcgcgcacaacgtcttccgttaaaccgcgcccagttgaaaagacgggctctacatcgtcgctaaagccgtagtcgtactcttcaaattggggcatcgttgtctcttctgtcattcgttagtttcctccgtttctgcgtggttcatcatttgaccggttgttgcacgtcggtcatcgctatttaaggctttgtggagcgccttccaagctaaagtcgcgcatttaatccgcgcagggaattgttgcaccccttgtaaaatcgcggcatcttctaacaatgaccagtcttcgtcacgatcaccaatcatcatatccgaaaagcgttcgatcatcgcctccgcttgcgccggtgtcttatgcatcacggcatcggtcatcatgctggcagaagcctggctaatcgtacagccttcccctgaaaaagcaatctgactaatctgcccgtcttcgagcaccagttcaagttgtaacacatcgccacaggtggggttgcgtaattcaatttcatgatcggcagtcgtcaagtgaccatgatgatgcggatgttgcgaatggtcaagaatgacctgccgatataagttatctaatttagagagtgccattttggaaaaactcctttgctgcttgaatggcggtcacgaacgttttcacgtccgcttcggtattgtagaggtaaaaactagcgcgcgcggttgcggcaacgttcaaccattgcatcaacggttgtgcgcagtgatgaccagcacgtacggcaacgccttccatatcgagggcggtcgctaaatcatgtggatgtaaattgtcgagattaaaggcaatcacaccggtgcgttgggcggcatcttgtgggccataaatcgtgaggccgtcgattgcttggagctgcggtaaagccattgtgactagcgcttgttcatgggcttggatatgatccatcccaatttgcgttaaataatcaatggcggcccctaagccaattgcccccgcaatgtttggcgttccaccttcaagacgccacggtaattctttaaacgttgaagattgtaagcccacaaagtcgatcatctcgccgccgtattccacgggtggcatctgttcaagtaatgcttgcttgccataaagcacaccaatgccggttggtccaagcatcttatgccctgaaaaggcgtaaaagtccgcatcaagtgcctgcacatcaaccatcatgtgcggcacggcttgtgcaccatcgaccaccatgtaaccgccttgtgcatggactaaagccgcaattgttttaatcggattgacaaccccaagtacgttggaagcatgcgccaaactaacaattttcgtcttaggcccaatcacctggcgtgctgactctaaatcgagttgcccatccggtaataagtcgatgtaacgcaatttcgcgcccgttttctgcgccagttgttgccacggcacgagattactatgatgttccatcacactaatcacgatttcatcgccggcttcaaccacggttgggccgaaactgcctgcaacccagttcaaactttgcgtcgtcccttttgtgaaaatcacttcggcactcgcagcggcatggatgaaggtttggaccttcgtgcgcgcggcttcatactgggcggttgctcgttcagctaaagtatgcacaccacgatgcacgttcgcattgtcattttggtaataagccaccaaccggtcaatcacggcttgtggtttttgggtggtcgccgcattgtctaaataaacaagtggttcatcattgacgatttggtctaaaatcggaaagtcgcaccgataatcatttaactggttgaccatcgattaacttcctttcaatcgtgtccgttaattgttggcgcacgtttttatccggaatttcacttagaacagcgcctaagaaaccacgaattacaagtcgttgcgcgacttcttttgaaagaccgcgactcattaaataatacatttgttgttcatcaacgcgcccgacactggcagcatggccagcttgcacgtcattttcatcaattaataagagtgggttcgcagccccgcgtgctgtccgcgataacatcaagacgcgattttcttgttgggcatcggcacccttagccccttttaaaatatgcccgatcccgttaaacgttaacgtcgcatcttctaaaatgacgccatgttgcaagatgtgcccaattgaacgcggcccaatattcgtcacacgcgtatcaatcccttgaatctgtttaccagttgagatggcgaccactttcgtttcagcatgtgatccagcacccactaaatcagaatcaaagtcaccgatgatattgccatcattcattgatcccaatgcccaatcaatccgcgcatcgcgcatcaagtggccccggcgattcaagtaagtcgtcacggattttccaaaggcatcaaccgctgaaaaatgaacgtgactgttatctttagcaatcacttccacgacaacatttgctaagttcttgtggtcacccgctgtttggagattttcaagataactaaattcactgttttgttcggctactacgaggacgtgatgaataaaatcagcgggttgagtgctgtcctgtacataataagccgtaatgggttgcttaatcaccacatttttcggcacatacaagaagagcccactgttcatcaaagctgtgtgaaaagccgttaagcgatcctcgttcggtttcactgtgacttgcatgtagtattgttgtaccaaatcaggatgttcttgtaacgcggtgaaaatgtcggtaaaaatgacaccttgttctgccaattctaccggtaaatttaacttggcagttgtctgaccaatctgtactgcgtacggttgatcagctgaaagattcgctgccgcagatggcattaaactcaaatcggatttaacggctgttggcgcatttgctgccatcactggccaatgtttatagttaattttttcaaagataggcagttcgagttgctcaatttgcgcaaacgctgcttgacgcatttcagcaaaccaggccggttcttgatgcaattgtgagaatgacgcgatttgttcaggcgtgatggctaatgttttcttcatcagaatcgccccctatttactttcgtcgtcagtcagtttgatatccaagcctaattcgtcacgaatcccgacataaccttcgtcttccaaacgttttgcaagtgacgcatcaccagtcgtgacgattttaccacccatcatgatgtgcacataatctggcacgatgtagtttaagagccgttgataatgtgtgatgattaatgagccaaaatcagccccgcgcatttcgttcacaccttttgaaacgacttgcaaggcatcaatatcaagtccggaatcaatttcgtctaggatggcgaatttgggttcaatcatcatcaattgcagaatttcattccgtttcttttcacccccagaaaatccttcgtttaagtaacgttctgacatttcttccgtcatatccaagaatgccatccgttgatctaattttttcaagaaagccatcactgaaatctgatcatcttcagcccgacgtgcattaatcgccgcacgcatgaattcagcgttcgttaccccttgaatttcagcaggatattgcatcgccaaaaatacccccgcgcgggcgcgttcatcaaccggcatttctaaaatattttggccatctagtttgatctgaccttgcagtacctcatacttgggattgcccataatcgtttccgaaagcgtcgacttcccagtcccgttaggtcccatgatcgcgtgaatttcacccgtgttcatttccaggttaacaccttttaaaatttccttaccgtcgatgccgacgtgcaaatcgataatctctaatttagacatagatgaccctccaagaatcgcattctagcaattattatacgctcttaattctatgctaattgagaactgttttcaatgcttgaatgcatgaaaaaagaccacgcggacaacgtgatctttttcaatagattcgcacgggaaataggttaatattactcattgatttgatactcttctaaaacattaattggcattggagtttaaaggagtatgttgaactactcattgatttgatactcttctaaaacagtccaccgcagagagattgtcgaccaagtgttgaactactcattgatttgatactcttctaaaacacgaggttggggtggataactctagtgcccgttgaactactcatctttattattcatcatagttttaaacgaaagattaaccgtccaggggttgattactcaacatttaagaatattttagcatatcttttcggtaaagtatacattgagcgacgtgctctaaatagcgtgtttgcctcgattcggttataattatcatattagtgagcaatagaagtgggggattgttatgttaatttggttgtcagtcgttatcattgtcgcgttagcgctttttttaacctggttgattaaacggttacgccgacaaagagcgacgcggattttacaacacagtagtcaagaaattgcggatgaaattgcaacggtggcttatcaaaaaatgcaagcgagtcagccggaaatttatgcacctcaagccaaactggtttcgaacctgcccactgaaatttggggcaataatgtgatggtcttcgaataccaagtgcccatccgacaaacatcgtctgcactaaaggatgtggcagccgcaattgaggaacaactcaatgaagtggcttacgaacggcggattgcctccgtcagtccgcgttatccggctttgctagtcactgatgtgtggtttttggaacaattgcattttgacgttgcttttattgtcaatcgcgaaacaatcgagtatgttaaagatatggcacaggtagaagattaaatttgcagtttagaaggagtttgcaccgatgaaattaatgtggcgctatacgatccgatataagaaattactattttggaactttatttgcgtatttggatttattctaatcgagttgggattaccaacgttattaggacaaattattgataaaggaattaatcaacatacttttggtcctgtgtggcaatttgggttgttgatggttgggatctgtttaatcggactaattggcttaattggtttggcttatactggtagcaaattaaccaccaatatcgtccgtgacattcgtaacgatatttttaaacaaaccatgcagttttcccatagtgagtatggcgaatttggtgtgtcttctttgattactcggaccactaatgatgctttccaggtgatgcaatttatgacccaagtgttgcggacagggtttatgactccgatgatgatcgtcgcgagtgctttcatgattgtacggacaagtcaatcactctcatggattgtatttgcggcaattccaatcctgctagcgggggttgtcttgattggtcgcgtttctgaaccgatgtcgacggaacaacaaaaaaatctggatgcgattaatctgaatctgcgtgagaacttgactgggattcgtgttgtccgtgcttttgtgcgggaacaattccagaaattacgctttagaaaagtgaatgatgactacagtcatagttcaattcggctgtttacgttggtggctttagcacaaccgggcttttcgttcatctttaatatcgtattcgttctaatcatttggcaaggggctgttcagattgatggtggtcacttagcggttgggacgttgattgcgtttattgaatatattttccacgtactgttttcatttatgttatttgccagtgtcttcatgatgtatccacgggccgctgtttcagcagaacgaattgaaaaaattctgaatgcgccaattaatattaccgaaaaagaagacggggtaacaacaaccgacacacaaggtgaattggtgtttgataatgtctcctttgcttatccaggtccgactgaaagtccagtcgttcgggatgtgacgttccaagcgcatccgggtgaaacggttgcctttattgggagtaccgggagtggtaagtcaacgttgattcaattgattccacgcttttttgacgtaacgcgtggatcgattaagcttgacggtcatgatgtgcgcgactatcaacttaaggcattgcgccaaaagatcggttttattccgcaaaaagcggtgttatttaccggaacaatcgcggaaaacttgcgttatggtaatccgaatgcgactgatgaagaattatggacagctttgaaaattgcacaatcagatacctttgtcgcagaaaaaccagacggcttacaaacttatttagccgaaggtgggagcaatttatctggtggtcaaaagcaacgtttggcgattgctagagcgattgtccgccgccccgcgctttatatctttgatgatagtttttcagcattggattataaaacggatgcggcgttacgaggtgcattgaagtcaatcaccaaagaggcaacagtgctgattgtggcacaacgagttgggactatcatgaatgctgatcggattgtcgtcttaaacgaaggtcaagtggttggcattgggactcaccgcgacttattaaaagataacgaggtttatcgtgcgattgcggcatcacagttatcacaggaggaactcaatgaagaatattagagaacttaaacggctaatgcgctacattgggccgtatcaagtgacattttggcttgcgattaccgcaactgttatttcggtgctggctaatgcactgtggccagtgattatgggactggccattactgaaatcagtcgggatttagcacaacacgttgcgattaattttagttatatcgcgaaggtgattgcgatgattttgagctttgcgttgctatatcaagtgacgatgtttttaggctcgttttggatgacgcgggctgttcaacgggcgatgcgtgatttacggcgcgacattgatttgcagatcaatgcgctacccgttcgtttttttgattcacaacaacaagggaatatcttgtcgcgggtaaccaacgatgtggacgcgattacgaacgctttacaacagagtttaattcaagttgtgacatcgattttaggaatcatcacggctgtgatcatgatgattacgattaatatttggatggcgctcttatcattaataatgattccagcatcgttattgatttcaagacgggtcattcagaaatcgcagccgtactttagaggccaacaagacacgttgggcgaaatgaacggctttgtacaggaaaattatggcggcttcagtgttttgaaactttacggacaagaagaacgcgcaattgaagattttgcagaaattacggatcggttaactgactatggctttaaggcagcctttgtttctggcttgatgatgccgttagttggtttaacgacaaacatgacgtatgccgggatggcaacgttaggcggttattatgtcttgcacggtgtgatttcagttggtaatttacaagccttcattcaatatatttggcaagtgaaccaaccaatctcacagattacacagttgtctggtgtgattcaatcagccgctgctgcaactggtcgtgtatttgaaatcttagatgagccagttgaagcaaccgataatgaaacagcatcgttgccagcagtcgttcaaggtaaagttgaatttgatgatgtcagtttcagctataacccagacaaaccattgattcgccatttgagttttactgctaacccaggtgataaagtggcgattgtcgggccaaccggtgctgggaagacaacgatgattaacctgttgatgcgtttttatgatgtgacatctggaacgattcggattgatggggttgacacaaagcaattaagcaagcaacaagtccgttcccaatttgggatggtacttcaagatgcttggttatatcatgcttcaatcaccgataatattcgtttcgggaaactcgatgcgacagagtatgaagtcgttgatgcggctaaaaccgctaatgtcgatcattttatccatacgctgccaaacggctatcaaatgacgattgatgaagaagcaagcaacgtttcgcttgggcaaaaacaactattgacgattgcccgagccgtgattgcggatcctaagattttaatcttggacgaagcaactagttcggtggatacccgattggaaggtttattgcaaaaagccatggaaaaagtcatgcaagggcgaatgagttttgtcattgcccatcgactctcaacgattcgcgacgcggatttgattttagtgatggaccatggtcaaattgttgaacaagggacgcacgattcgctattagctgccggcggtgtgtacgctaatttatataacagtcaatttgccgatacgcctgaagcggcggaagcataaaaaagcgtgattgaaatctcattagaagatttcaatcacgcttttttatgtgcttctcgagtagcctttaccgttaagcctcaaagcctgactaactcgaatcagcacttcttctttaacgtgcgctcagttgctaagcacaaccaatcgcacttctattcaataataatcatgtcatctggtgctgcgaatgggtcttgcttgttgatgtgatcgaagaacaagatgccatttagatgatcgatttcgtgttggcacacaatagctgggtagttttttaagcgaatcttgtggctttcaccgtctaaatcttggtaacgtagtgtaatacggtcaggccggggcacaaagccgggcacttcgcggtcaactgataagcaaccttcaccttcagcaagtgctgcgttttgaacagagtggctgataattttagggttgataatcacatctttgaagatgggttcgtctggtccagggaccaagacagcagacatttgttttgaaacatctacttggggtgcagctaaaccgacgccagcgcgcaagtggtacttttcagcaagttcaggatcttggctattttctaaaaatgccatcatgtcagcagcaagttgccgatcttcatctgatagcggaaaagtaacaggttcagctatttttctaagtgttgggttaccctcgcggataatatctttcattaatatcacagttaagacctccgattaattcgtcattcattattctagcacaattcaagttaaaacggaatgaattgcttgacctgctaaagtgaaacgggtagtatgaaagtatagatatattgcttttccgttaggtgaggctcctatatgaacaaacgctgctactcagaaacatcgagagatgccaattgagtcaactgaaactgccaatgaaggctttttctaacgtagctgaacatggtttctacgtcatatagtgctaaaactgaacgattgggaacgtcatgataaatggatgacgctcaattgttatgcgtctttttttgtcggataaagcggtatgactaaatttaaagtagagaaagtctggtgagtaaaatgatgaaaacagctgaaggacctgtaagtagtagcgatggtgatcattcgaggtggtctgtcattttactgccagcattaggctagcggtttacgacgacttcctcaaaagggaaggagtgtcgaacgcgatgcacaagaaattaaaaaaagacgttaacatcactggcattacaagcagtgggatgttaatgcgtttattggcaactcggccaagtggcttaacaactgtcgaagctgctaaaagagaaacagtattagaaaattcacaagcacgggttagcgttatgcgtgatggctttttacgcttaatcggtgcagatcaaattgtgcccggtgatattttggtattggctgctagcgaaaagacacccgttacaatcgcaacagttaacaaagatgttaacgttattgaagcgggcgaagcagtgactgaaatggtgcacggcgttgtgctagatgcaacgattggcgctaaagcacaaacacctaaagttagagtgggaagcacttttatgatggcggtagctgcattggtttcattttgtgcagtattaatggttaatcaattcgctttcatgggcttggcaacgctggttgtcggggcaatcctgctaacaatgattaagttagtcaatcttggtcaaattaaggttgcgattgatttaaatgatttgcgggtaagtgaacggtgcgtgcaagtcagtcaacaaattaaaccagtagtcagagtgtttcaagagctcttagtacatgctggcaacgctgagataccccaaccggtcttggcatagaactaccccaacttaaatttaacgatgagtctgctacggcggactctttttttgtgcttattatttgctattatataacagaaaacgaaattaaattataacagatatataacagacgtgaaaattagctaactagtgattagattcacatgtaataaaaactaatgaaagcgtaagctgactaatatagcttataaaacgcttgcatttagtgatgtgaaatgctaaattagtcttgtaaagatgcttaagtaatacagatataagcagttattaaaacagttttttaaagaggagatatggatactatggccaataataaagctgcagttaattttgagaagttattgagcgatgagagccaagattttaagaccgttcaaattttagatgaggctggccaggttgttcatccggaattgatgccggatctcagtgatgaccaattggttgaactgatgaaacaaatggtttggtcgcgtgtgcttgatcaacgagcaactgctttgaaccgtcaaggccggttaggattttatgcaccaactgctgggcaagaagccagccaattagcaagtaactttgcgatgactaaagacgactttttattccctggttaccgggatgtgccacaattagtgcaacatgggctacctttatcacaagcattcctatggtcacgaggccatattgacggtaacaagtatccagaatctttgaaggcgatgccaccacaaatcattatcggcgcgcaatacattcaagcaatgggtgttgcggttgggatgaagaagcgccaatcagaaaatgctgtttacgtttataccggtgacggtgggacttcacagggggatttctatgaaggcttgaactttgcgggtgcttttaaagcaccagctattttcgttgttcaaaataacggctttgcgatttcggtcccacgtgaaaaacaaacagctgctgtaacgttggctcaaaaaggggtcgcagctgggattcctgccattcaagtcgatgggatggatccactagcagtttatgaagtgatgaaagaagcgcgtgaatttacaactgctggtaacggaccggtcttaattgaaacattaacctatcgttatggaccacatacattatcaggggatgatcccactcgttatcggaccaaagaaacagacgatatttggttgaaacgtgatccactcgttagaatgcgccgtttcttaactgataagggactttggtcacaagatcaagaagaccaattgatcgaacaagttaaaacagacattaaagcagccatcaacgaagcggatgctgcgccaaaacaaaaagtcacagatttcttgaatgttacatttgaagatcaaccacaaaacattaaagaacaaatcgcagaatacagtgcaaaggagtcgaattaagatggcacaaaaaacgatgattcaagcaattacaaatgcgctggatttagaacttgcagatgataagaacgtcttgattttcggggaagatgttgggaagaacggtggggttttccgagcaactgaagggttgcaagctaaacatggtgaagaccgggtttttgatacaccgttagctgaatctgggattggtggtttatcaatcggtttagcattagaaggcttccgccctgtacctgaaattcaattctttggttttgttttcgaaacaatggattcgattgctggccagatgtcacggacacgttatcggatgggtggcacacgcaacatgccaatcacgattcgtgcaccatttggtggtggcgtgcataccccagaattacattcagataacttcgaaggaatgatcacgcaaattccagggattcgcgtggttgtgccaagtaatccatatgatgccaaaggcttattaatttctgcgattcgttcaaacgatcctgttttgtatcttgaacacatgaaattataccggtcgttccgcgaagaagtacctgatgaatcttatacagtgccgcttgataaagcagctgtggttactgaagggacagacatttcaatcatcacttacggtgcaatggtgagagaagcgattaaagcggccgaaaacctagctaaagagaatattaaagctgaagtaattgatttacgaacaattgcaccattagatgttgcaacaattatcgcctctgtcgaaaaaacagggcgggtcgttattgttcaagaagcacaaaaacaagcaggcattggggcacaagttgcttctgaaatttcagaacgtgctgttctttcattggaagctccaattgcacgtgtttcagctcctgatacgccatttccatttggacaagctgaagcaacttggttaccaaatgcaactgatattgaaaataaggttaaagaagttattaacttttagtcgataacgaaagaagggacgttagacgtatggcatatcaatttaaattaccggatattggtgaagggatcgcagaaggcgaaattcaaaaatgggcggtcgcagaaggtgacacgattcaagaagatgatgtcttacttgaagttcaaaatgataaatcagttgaagaaatcccatcacccgttagtgggaaagtcgttaaaattttagtcggtgagggtgaagtggcaacggttggacaagtactggttgaaattgacgcaccaggtgttgaaggtaacgatacaccaagtacggcaacaccagctgctacacccgaagcaacaccgactgcaaccgatgtaggtggtgtttaccaatttaaattaccagatattggtgaagggattgccgaaggtgaaattcaaaaatgggcggtcgcagaaggcgataccattcaagaagatgacactttattagaagttcaaaatgataaatcagttgaagaaatcccatcacctgttagtgggaaagtcgttaaaatcctagtcggtgaaggcgaagtggcgactgtcggccaagtattggtcgaaattgatgctccaggtcacaattcggcaacggcaacatctgctgaacaagcaccagctacggcgtcagaatcaacaccagctaaaacaacggcgccaagcagtcaagcagtagttgcgattagtgaccaaaatcggacgattttagctatgccatctgttcgacaattcgcacgtgaaaacgatgttgagatcagtcaagtgccagccaccggtaaacatggtcggattactaaagaagacgtgcaaaacttcatgcaaaatggcgctgcaacaacgacaacgcctgctgtagagacagcagaacaaccaacgtcgccagcaatactagctgcacaaccagtcactgcgacaccatacacctctgcgacaccagaacgggaaacacgtgaaaaaatgtcaccaacgcggaaagcaattgctaaagcaatggtgacaagcaagcatacggcaccacacgttactttattcgatgaagtggaagtttctaaattgatgacccatcgtaagaaattcaaggatgtagcggctaagaaggacattaagttaaccttcttaccatatatcgttaaagcattagtgacggtcttacgcgacttcccaacgttaaatgcgtcaattgatgatgcaactagcgaaattgtttataaacactacattaatgtcggaattgcaacggatactgatcacgggctctatgtcccaaatatcaaggatgccgacagcaagagtatttttgccatcgctaaagaaattggcgaaaatacgcaaaaagcattggataacaaattgaaaccagctgaaatgagtggtggttcaatgacaatcagtaatatcggatcaattggtggcggttggtttacaccggttgttaactaccctgaagtcgcaatcttaggggttggccgaattgggacagaaccaatcgtcaacgctgatggtgagttggctgttggcaaagtcttgaaattatcactatcatttgatcatcgtttaattgatggtggaactgcgcaacgtgcgatgaacgaattaaaagaattattagccgatccagagctattattgatggaaggatgattttaaaatggttgtaggtgattttgcaattgaattagacacagtagtcatcggttcaggtcctgggggctatgttgcggcaattcgcgcggccgaaatgggtcaaaaagtaactgtgattgaacgtgaaacaattggcggtgtttgtttaaacgtcggctgtattccttccaaggctttgatttcagccggtcatcgactacaagaggcgaaagattcatctgtctttggtatgacgactactggagcaacattggattttgcgaaaacgcaagactggaaacaacatgaggttgttgaaaaactaactggtggcatttcaatgttgttcaaaaaacacaagattgatgtgttagacggttcagcctttttagtggacgaacatagcttacgcgtgattaaagaagagagtgcacaaacgtacagttttaaaaatttaatcattgctactggtagtcgtccaattgaaattaaaggcttcaaatttaataaacgggttattgattcaactggtggtttaagcttaacggaagtaccaaaagaattagtggtcattggtggtggctatatcggctctgaattagcaggggcctacgccaacttaggtgcacatgtgacgattctcgaagggacagactcgattttacctaacttcgaaaaagatatggtgcaattggtgacaaagaacttcaaggctaaaggggtcgatgtgattactggcgcaatggcaaaagaagctgttgaaactgatcaaaatgtaacggttaaatatgaagtcggcggcaaagaagaacaacttgttgccgattacgtgatggttactgttggtcgtcggccaaataccgacgaaatgggactcgaacaagccggtattaagatggctgatcgtggtttgattgaagttgatcaacaaggccaaactaacgttaagggcatctatgcgattggcgatatcgttgctggagcagctttggcgcataaagcaagttatgaagctaaagtggctgcagaagccattgccggtaagaaagtaacggttgattaccacgcaatgccagctgtttgttatacagatcctgaattggcaacgaccggtttaacggttgcagaagccaaggcaaaaggaattaacgctaaaggatttaagttcccatttgcagctaatggccgtgctttatcattagcagatacagaaggtttcgtgcggttagtgacgaatacggatgacaacacagttctgggcgctcaagttgctggcgttggcgcaagtgatttaatttctgaattgacgttagccgttgaatcaggcatgaatgcagaagaccttgctctaaccattcatccacatccaacgttaagtgaagcgattatggatgatgccgaattagcattaggattgccaattcatatttaataaatagtttagaatgacgacgcaccagttgagtgcgtcgttttttgattccgctatttctaaaaggattcgacagcttctaaaaaaatgcgttataatgtgagagattaatggcatcagtagaattgaaactggcgcaaatttatgcaaattttaggagcctttatgcaaacgaactatagttatcctttagaaccagactggacgccagctgaagttgtccaagtcatgaaattatataatcttgttgaacaagcttatgaatttggtgcgaaagttgcggatttacgagctgcttatcgtgatttcaaagtggttgttcaaagtaagatgcaagaaaaacaaattgataaggccttttcagaagcgtcaggctattcaatatatcggtgtatgcaggctgcaaagaagagtagtcgaacccaaatcaaaatgacgcttaattagtgaaagtggatgaaaaaatggaacaagaagcactgtatcggttaagtcgttcgctgcaaaagtggatccttgaagcagctgcctatacccgcacacaaattaaacaaccattaacggttagtactaagtctgggcctaatgatttagtgactaatgtcgattgtgctaatcaagctttcttagctgaaaagattaagacggcttatccgaacgcgcaattagtgggggaagaaggtgccggtgaggtgcctgatgattggcaacagggactaactttttttattgatcccattgatggcacgatgaatttcgtgaagcaacgggcaaatttcgccattatgatcggcgtttatgaagacggtcagccgctattcgggattatttatgatgtgatggccgatcaattgttctggggcggtccgcagttggggatattcgaaaacgaagctgccctcaaaaatgctgtcgacgagccgttgcaagaagggttaatctgtgtcaatacacggatgctggtcaccaatgaagcacacttgcaagaggtgttgtatcaatgttcgggtgtgcggatttacggtagcgccggtatcactttcgcccatttgttgaaggggcaagtgcaagcttacatctccaaattagcgccatgggacattgctgcaggtcgggttttagctgagacgttaggttttcaagttttacaatttgatggtcaaccgatttccatgatgcgaaaagaagggatgattatcgcgccaaagcaagcaatacaagaaattgtcacgactatgaatggttcaaatgattaaagataattaaattttcatgaaaaaaacttgcgtattttcaaaaaaacgctaatatatgaagcacagcccatttttttatggtaaaataatagcttgtatacatgagacaaacaacactagtcaagtcactagcgagaggaagctgaaacacttgaaaaaaagagaagacattcgcaatatcgcaattatcgcccacgttgaccacggtaaaacaactttagttaacgaaatgttaaaacaatcagatacattggatggttacgcagaaatttctgaccgtgcaatggatacaaatgatatcgaaaaagaacgtgggatcacaattctttcaaagaatactgctgttaaatataacggcaaacaaatcaacatcttagatacaccaggacatgccgatttcggtggtgaagtggaacggatcatgaagatggttgatggtgtgttattagtcgttgatgcttttgaaggcacaatgccacaaacacgttttgttttgaagaaggctttagatcaacatttaacaccaatcgttgtgattaacaaaattgaccgcccaggcgctcgtcctgaagaagtcgttgatgaagtgcttgaattattcatcgaacttggtgctgatgaagatcaacttgaattcccagttgtgtacgcaagtgccatcaacgggacatcaagtcttgaatcagatttagatacacaagcccatacaatgaaccctatctttgacacaatcttagatacaatcccagcaccagttgataatagtgacgaaccacttcaattccaagtggcaatgttagattataacgactatgttggccgtatcgggattggccgcgtttctcgtgggacaatcaagatcggtgatcaagtttctgttcttaaacttgacggttctgctaagaacttccgcgtaactaagatttttggtttcatcggtttagaccgtgttgaaatccaagaagccaaagcaggcgatttaatcgctgtttctgggatggaagatatctatgttggggaaactgttacaccagttgaccatcaagaagctttaccaatcttacggattgatgaaccaaccttacaaatgacatttgctgctaatgattcaccatttgttggccgtgaaggtgatttcgttactggtcgtaagatcgaagaacgtttacgtcaccaattacacactgacgtttcacttcgtgttgaagataccgacaaagccggcgcttggattgtttcaggtcgtggggaattgcatctttcaatcttagttgaagaaatgcgtcgtgaaggtttcgaattacaattgtcacgtccagaagttatctatcgcgatattgatggcgttacatgcgagcctttcgaaatggttcaaatcgacacacctgaccaatatactggttcagtaatcgactcaatggcccaacgtaagggtgaaatgcaaaacatggaaagtgatgctaataaccaaacgcggatgactttcttagcaccttcacgtggtttaatcggttattcaacagaattcttaacgatgactggtggatacggaattatgaaccataccttcgaaaaatacatgccagtgattaagaactgggaaccaggccgtcgtaacggtgcattagtttcaatcaatgcgggttcatcaacaacttatagtttacaatcagttgaagatcgtggccaattattcatcggcgctggcgttgatgtttatgaaggcatgattgttgggcaaaacagccgtgatacagatatcgccgtaaacgttactaagggtaaaaacttaacgaatacacgtgcttctggtaaagatcactcagctgccatcaagacacctaaagaaatgtcacttgaagaatcaattgaattcttaaacgatgacgaatactgtgaagtaacacctacttctgttcgtttacgtaagaagattcttgacacaagtatgcgtcaaaaagctgataagaaacgtaaaaaaggttaatcattaaaaaccattagaggtagccgcttggctacctttttttgtgcataaatatggtataataacgaacagagtatgctttttaataacgaataggtaggcgtaaattatgattgaacaaaaaacaacagcttatctcactttagaagcggatgcgctacgcattgagcaactattgcgtgctcaaattgatgcgctttgtatgagtcaatgtccaattattgaagaggtaattgatacccaattatttggtttctcgcgcgaggttgattttgcaaaacggatgcaacttattagtgcgccacagggtgcaactttgatgcgtgagttagaagaacgggtcaatcaaattggcatgcaagttgggcaaggacaggctgaatacgaacgaaatagaaattaggtgtaactgtgtggaaaaagtttcaaaaaagtaaaattcagtatttagactattggttattgctaccatatgttatcttatgtgcatttggtgctttaatggtctattcggcgagttcggatttaatgtcaattcgcggaatgaaaccagatgcgtattttaccaagcaattagtatttatcgcgttaggctttattttgatgatgatcacatattttcttaagttatccgttttaaaaaatcgcacttttctaaaagcaatgacgattgtggttttcttggcgctcatttatttattgctgttaagtcgtttcagaccaagcgcagcgattaatggggctaccgcgtggattcaattgggaccactgaccattcagccgtcagaatttgcgaaattattgattgttatttaccttgctaatatgctctcacgtaaggaaaatgaactggccgacggatttgttgataatttaaaattattctttagtccggttgtattagtcgctggaatcatcttactggtgtttattcaacctgatttagggggcgctagtatcttggctgctgtgatggtagtcatgttttttggcaccggtatgtcatattggtatggtttttcactgattacagcggtcacaacaacggttatgattttatttagtattttacggcactttaacttttcaacgaacgttaattcttataagttcaaccggattttatcgtttttacatccatttgaattggaaaatatgggtgggagtcagttagtgaattcctactatgcgattaataatggtggttggtttggcttggggcttggcaatagtatccaaaagcgcggttacttaccagaaccgtataccgattttattttatcgattaccactgaagaattaggtgtgattgggaccctcgtgattatcgcgttactatttgcgctactagcacggattttttacctagggattcatgcgactaagatgtatcacactttattatgttacggaattggcactatcattttcgtgcaaaccctattcaatgttggtgggttgctaggaatcttaccgattactggggtgacgttaccgttcatcagttatgggggatcaagtatgatggttctagcgattgcactgggaatcgtgttgaacatcagcgcacaagagaaaaaagctgcggcagcgaattagtgaggtgaaagcatgataaaaggggcacgccgattaatcgttgcattgattgtctggttggtcatcctttatggttggccgattatccaaacaccagcggttaatcagcctaaggttgcacaagccccgtcgactgaacggtcaataaaacaaacgccactgacgaaaacacaagggccggcgaaactgattaatcaaccagctgaacaattaattgcaacctatgggcaaccggtcgagcaacagctgactgatgaaaatcaacgacggtggttatttcacttagatagccgacagtatgtcgaagcgctgattgataaccaatccaatcaaacacaacaaatcatggttgttggtgcggacaacgatgtggcgccgtttcatttttttcaaaagcgggctacattaactaagaagacggcgttaccaacttcgctcttagtgacgttacacgagcaacaatttaagttgcggttaacgccggagcaacaccaacaaacgccgttagtgatgtttaaaaaccagacgtttgcaactttagtgatgcagcaagaacgattgacagctgtgatgtatttaaatgcgaaccgactgctacaaactgatttatatcgagttgtttcaaaaacaccagtcccagtggatgagctagcaaagtcgcaacaaccgcaaacagatagtcaacgacaactcgctttggtgcaaacgttgcagacattacgccaaaataatgaccaacctgcgctcacgataaatcaactaccattgcaaaatacacagaatttggtgagtgaattaacaagtacaccaacgcagtggttgactaaaaagggactgcaaaagctgcaccaagtgcgcaaacaagcgacacaagagacggacgcctttttaacagcaaccgactttaaacaggctccgttaagagcagcgggttttccgcagcgcgagcaacttttttattggccacaagggctcaattcccaagggctggtgcttgcgcaacaacagaatctagcgttgcaacttgcgattaataatccaagctatcagcacttaacgcttctgtgtaccgatgaacaaacaatgatgatttttgactaaatgtaaaaggactgattaaatgacattggaaatcacacaacgccaaggaattgtcgtctggctctattcattacgacaagtaaagcaattacgccgttacggacttgtgtattacacctcgaaacgaatgaaatatgtttatctatacgtagatatggcagatgccgaaactgttatgcaacggttaaaaaaattacactacgtcaaacgagtgaccccttctgaaagaccagctattgatatggatttcagtaatcgagtaggacgctcagatcaagaaattgccgatgcggcagaattagaggagtaatagagatgcggattattgcaggagaatttgggggtcgcaagttaaaagctgtccctgggatgaaaacacggccaacaactgacaaggttaaagaagcaatgtttagtatgttggggcaattttttgacggtgggcaggcgcttgatttatatgccggtagcggtggtctcgcaattgaagccgtttcacgcggtatggatcatgcttatttagttgatcgccaatatgcagcgattcaaacgattgaagaaaacgttgcggttactaaaatgccagaatgctttacaatctggaagatgccagctgaaaaagcgttggtgaaactagcggatgctggtgttcaattcgatttaattttattagatccaccctacaaggaacaacagatgttgcttcagttacaacaattcgtcgaaatggggttattagcaccagacgcgacgattctttgcgaaaccgatacgacggttgattatccaactgacattccgcattacatactgaaacggcaacagaattatgggattacagaagtagcaatctttaaatttattggttaggaggcagctatatgccgaaaattgcattatttccgggaagttttgacccgtttacaaatgggcatctcgatactgttgaacgggcaagtcacttgtttgaccaagtgattatcgcggtgatgactaacgctgctaaacaaccgttatttgacgcaaccactaaggttgaactgattgaagcggcgacgcaacacttggataacgttaaggtaatcgcacaatcgaagacgttgacggcaacctttgctaaagaagtcggtgcgcgatatttgattcgtggtattcggaatgccaatgattttgagtatgaacgtgatattgcggcgttgaatcagacacaagatgctgatttagaaacggtgttattattagcaaagcaagaatttgcttttatctcatcaagtatggtgaaggaaattgcaacgtttggtggccaggttgaacaattggtgccgccggttgtcgcgtctgcgcttgcacaaaaattaggacctgaaagtgattaatatgaataagaataaacgtctattgaagcatctcctatggattgttggcttgatcgtcgtgtttgctttttgctttatcccaacgcattattacgtcgaaggggtcggttcggccgaaaataccaaccagtttgttaaagttaacggtcaacgagatcaacataagggccactttatgttaacaaccgtcgggattcaaggaccagtgacggggttacagctattactgtctaaaacacaaccttttacggagattattagtcgtgatgaactaatgggtgacgatgatactgaagcgtatgatcagattcaaaaatactacatggaaagctcgattaattttgcgattgaggcggcttatcaaaaggcacatcaggaataccacactcaatatctgggtgtctatgtgatgtcaattttagataattcagcttttaaaaaagatctggctattggtgacacaattacggcaattgatcagcatcaatttaagagtacaaataagttcgtcaagtatgttcaagggcttaaagtgaatcaaaaagtcacgattagctatgaacataatggccagcgtaagactgcgacccgtaaattgattaaattacctaaatcgcgctacgctggtttgggaattacgctgacagatcactcaaaaattgtgacaaaagtgccggttaagattgatgcgggtgaaattggtggtccttctgctggcttgatgtttacgttacagatttataaccaattaacgaaacaaaacttaacgggtggtcgcaagatttctgggacggggacaatggatcctgatgggacagtgggaccaatcggcggaattgataagaaggtactgattgcgagtcaagaaggcgccaaagtctttttcgcacctgatgatcccgtgacaaaagccatactaaaggtagaaccccattatcaaaataattatgcgattgccaaagcagccgctaaaaaaattggtactaagatgaaaatcgttcctgtcaaaaacttggacgacgcattggattatttagccaaacattaaaaaatttgtcggttcgaaagaatcggcaaattttttttgcgttttggggtaattaggaataaggaggtggcgaaaaatgtggcgcgactattggcaacggtatcgtcgattctggtgggtaccttgtttggtgataattttacttggtggtggtgtgttttggcagcatagtcggcaacaacgttttctatcaaccaatcaacaattgatggcgcaatcaactaagcgaaaagtgaaggcaaaacccgtcaaacagaagaaaagcgtctcaaaaggtgggtttgtcgatatcaaaggcgctgtggcacatccagggatttatccgatttgtgttgcaaagacgcgtttatttgaggtgctgaaacaagcgggggatgtgaccgaagcagcggatacgagtcagttgaacttagcgcaaacattgagtgaccaacttattatctatgtgccaactaagggagaagcggtgcaagccgaagaattagtgaaagcggcagacgagccacaggctgcgactgacaatcaagcgggagccagtccgatatcaactgatgctaaaatcaacctaaaccaagcggatgcgacacaattgcaaacgctaaatggcatcggtcctaaaaaagctgaacaaataattgcatatcgggatgagcaagggcagtttaaacaaatcgaagatcttcaaaaagttgggggaattgggccgaaaacgtttgaacaattacggccacaaatttgtgttaattagtttgtgaatggtatttttttgctatactaaaactattaactttaaagggggaattcgtgtgtcagaaaagagaatgccgtggaatcaatattttatgcttcaatcggtcttgttgtcgatgcgtagcacctgtccaagattgtttgtgggtgcgttggtggttcgtaatcggcgaattattgcgggaggctacaacggttcggtggcacatgaaagtcactgtatcgatgttggctgtttattacgggacgggcattgtttacgaacaattcatgccgagatgaacgccttgactcaatgcgctaagtttggtgtgcagacggaaggggccgaaatttatgtcacacattttccatgtcttcagtgtactaaattaattattcaagctgggatcagtaaaatccattatcaaaaggattatcataacgacgaatatgcgtatgaattgattgaaaaatctggtattgaattggaccaagtcgatttaacggcgaatgacgccaacaccctcgttaactttttggagaatgaacaaactgctgagtgattaagaataactgggtttatccagttatttgtttagcaagtttaaatgcgttattactaggacaagcaccactttttttagctgtcttttgatagtgtgtctactgcgactgtggtgcttacgccaaccagctgtgttaatggtcagtggactggtactgtgtttaggcggttgccgtttttggctggcacggcgcacctacgaacagccggttagaccaaataatcaagtatataagattcaacccgatacgatcaaagtggctggcgatcagattcaattaatggcgcaggggcagaatgatgaccaacgtgttgtttgctactatcgctgccagagttcagcggaaaaacgccgttggcaaacgacgaatcagccgttattattagcgggtgatattgaattagagcgtatccaaggtgctactaaccggaatgagttcgactatgcgcgctttatggggcagcaaaagcattgtttttatcaagcaaatataattgacggaacggtctttagacgcattccaccacaaggttggctagattggttccaccaacggcgccaacaggggctgatttatctccgacaattgccaccagcgttgagttttcatgcagaggcgttgttatgtggtgttcgagagtcagatggcctggcctaccagaatgtgttaggtcaattggggattattcatttattgagtttatccggattgcatgtattctactttgtgacaatcattcgtcgattggcaacgctgtgtcgagtcccgcgtgaatgggtgaatgttagcttgttttgtttgctacccctttatgcgttgtttgtggggggaggcacgagtattacacgcgctatcgggctgatcttactacgattaatctgcgaagtaagtcattttcagcaatcgcgtttagatagttggagttgggtattgctggtcaatcttttatggcagccgtatttattaatcagtatggggggattgctgagctatctgatggcttttggattgatttatcagcggcgccatggtacttttacaacggcattttggctaggcttgttaagtttaccggtgtgcttgcggtttaattatcgttggcatatcttgacgattttgattaatgggattgtcgcgccgattttcttaccagtcatgttgggtttgattatggtagcgatttgcttatggcctgttagtcatatgatagtttggttagaagaaggcctgctaacgacgctgtataaaggattagcttggattgcaacgttcccatatgcgacaattactttcggtaaaatccagctaataccactctttttaattgtgataggcacactatggttgatggcaagtactggtcggcgagcaaagtggggctggggggctgttatcagcctgtatgtcattagttttattggtatccactttaatccggttggccgcgtgattatgtttgatatcgggcaaggcgatagcctgttgattcaacaacccttcaatcgacataacctgttaattgacaccggcggccgactagctttaccgcaagaaaagtggcaacggcggcaaattgtgagtcgggcggaaaaagtaacagttaattacctctacagctgtggcattgatcatttagaggcaatcgcattatcgcatcaggatgctgatcatataggggacttaaatgaaattatgcaacatatccgagttaaacggttgatttgtgctgcgggcttaccgcaaaaccggcagtttcaacggcaagtgcggccgcatcttacaaaagttacaattgagccttatttggcggaccaacattttatgattggtcaccaacaaatcaatgtgttagcgccagtggtggccggaccaggcgggaatgctgactcactcgttttgcaaacgcaaattggtggtgcgagttggttatttactggtgatttagaaaaagcgggtgaagtggcaatcgttgatcgctacccacaattacgcgttgattacctaaaggtgggtcaccatggcagtcaaacggcgagtgatccccagtcaattgcgacgtggcaggtaaaaggggcgttgatttctgcgggacgccataatcgttatggtcatccacatgccgcaacgttgcagactttaaaacgtgcgaacgtcccattttggaatacggctgactgtgggatgctggaatggcgctatggttttggccaagtgccaatgattaaaacaacactaaaggattgtgactaaatgaagacagaacaactaaaaacagcactgaatcgaggaacgtttgcaccggtgtatctcgtattaggacaagagtcagcgctgattgaagaggttagagcgttatttaaagcaacgctttcgacagaagaaatgacgatgaactttgcgagttatgatctcgcccagacggaggtggcgcgggcattagaagatgcggaatcggccccctttttcggtgagcgacgaattgtttttatgcagaatccattcttcttaacaggtgaaaaagttaaaactaaacttgatcatgatttaaaaggattccaagcttatttagaacagccacaaccgacaacggcactcgttatcttcgcgccatacgcgaagttggatgaacgcaagaagattgttaaacaactgaagaagatggcaactgtcattgacgttcaaaagattaatgagcgccaggtccagcagttagtgacagcgcaactgcaaagtgaacaagtcacgattgaaccagcggcaatgacgttattgttaagcaagactaatggtgattacagccagattatggctgagttacccaaattactgctttacgcgcaacaaagccgggtgattactgaggcggccgttagtgcattagtggcaagtagtattgaagataatgtttttgaattggtgccgttagttttacaaaaaaaggtcggtccggttttagagatgtatcacgatttattgctacaaaaagaagaaccgctgaaaattaacgccatcttgttgggccaatttcgcttgttactccaagtgaaaattctttttgaaaaagggtatagccaaggtaatttggcgagcgtcttaaaaattcacccataccgcatcaaattagcattgcaacaaattcggcacttttctaaggcgacgcttgcccaagcctatctaggtttagaaggcattgaggaaaaaataaagactgggcaaggtgaagcaaccttattgtttgaactgtttatgttacaatttgcgacagatgatgttgcttaaagccaaaaaagcccccacaaaccaaatggttgtgggggctttttttgtggttaaattatttagccatcattttgtttaagcgtgacttgtcacggccagctttgttggcatggattaagccttttgttgaggccatatcgattgcgcgtgtagcagctttcaataggtctgcagcttcttcgttgcctgctgttttagcagctttgaactttttgattgctgaacgcattgtgcttaattgagaagcgttacgttggttagctttttcaattgttttcacacgtttcatagcagatttaatttgtggcatgttgttcacctccgatgggtttcactatctttataaaaaagatttttaatttcaacagtcgttattataccaaaatagtgagagtgattgcaataaaaacttgtaaagtatttcaacttgactgcttaaatagtttgaaactgtgccttgcttttgacactaatatttagtaaacttaaaaagtgcttattgcacaggcctactactctgtttagcgacgttcacccgacgctttacgttgttctaggctattataccagaagggtggaaattagcatggctatttcacaagaaaaaaagaacgaaatcattaaccaatttgctcgtcacgaaggcgacacaggttcagcagaagtacaaatcgctgtattgactgcagaaatcaactcattaaacgaacatttatctgttcacaagaaagatcaccattcatatgttggtcaaatgaagaagatcggtcaccgtcgtaacttattacgttacctacgtgaaagcgatgttcaacgttaccgtgaattaatcaagagccttggcttacgtcgttaattcattttcaaaaagcgggtccgttatgcggacccgctttttttgtgctcaaaaggcttttagtaatcaaaagctgttagtttgtttaaattgtgataaaatatgagttagactttaaggcggatgagttttaaacgaatgaacgactaaaacaaacaaaatagtttggggaataaattcctcaagtgctagaggtgaaagaatgagtaacattaagattatgccacttggcggtgttcgtgaaaacggtaagaatttgaacattgttgaagtggacgacgaaatttatgtattagattgtgggttgaaatatccagaaactgaattattggggatcgatatcgttattcctgatatgacctatttagaagaaaatgcagaccgtgttgctgggattttcctaacacatggtcatgctgatgcgattggagcgcttccttatttcttaaaggaacatgatgtaccagtctttgggtctgaattaacgattgctttagctaaaattacggttagcagcgaaccaaaattacgtaagttccaaaacttccacgtcatcgatgcgaatacagcaatcgattttgaacgcgcaaccgtttcattcttcaagacaacgcatacaattccaggttcattagggattgtcgttaagacggatgaaggacaagtcgtttatactggggactttaagtttgatcaatcagcaatgccaatgtatcaaacggattatgcacgcttagctgaaattggcaaacaaggtgttttagcactcttgagtgattctgctaatgcggaatcaccatttgcaacggctaacgaacgcgatattgctgaatccatcttagaaacgttcaagtatcaaacgggtcggatcattgtggcttcagtggcttcaaatattatgcggattcaacaagtcattgatgcggcttataaaacaggccgtaaagtggttttaacgggtcgtgatttagaaaaaatcgtccggacagcaatgaaattatcgatgattattttgccagatgacgatatcttggtccaacctaaagatttaagcacacttgcaccagaacaaacagtgatcttagaaacaggtcggatgggcgaaccaatcaaggcgcttcaaaagatggcaactagtcatcatcgtttaattcacatcgaagaaggcgacttggtttatttaacgacatctccttcacacgcgatggaaacgattttagcgaagaccaaagatatgatttatcgtgcgggtggcgaagttaaggcggttggcgatgatttacatgcttcaggccatgccaataagaatgacttgcaattaatgttgaatttaatgcaaccaaaattcttaatgcctgttcaaggcgaataccggcaactagcagcacacgctgatattgctcatgaaacaggaatggattacaaagatattttcatcgttggtaaaggcgatattgttgcttacgaaaaagggaagatgcatgttggcggacaagttgacgcaactgacgtcatgattgacggtagcggtgtcggcgatatcgggaatatcgttttacgcgatcggaaattattatcagaagacgggatttttatcgctgttgttacgattgaccgcaagaataagaagattatcgcggaaccgaaagtcaccgcacgtggttttgtttacgtgaagactagcaaagatttaatggctgagagtgccgaaattatcaaaaatgcggtgcaaaataatctggacaacaaagaatttgactggagtcatttgaaacaagatgtccgggaaaacttaagtcattacttgtatgaacaaacgaaacgtcggccagtgattctaccagtgattatggaaattaatcaaaatcatcgtcgtcaaagaaaagataataaaccaaaggctgaaaaagccgctgaataacatttagaaacaatagcgtctggatcaggtcagttgattctaggcgctattgttttattaattgtcaaaaggaagtgattgaatgggtgacattacgcaatttccagatcagtatgatcggctgatacggatggggaaagtagcgttaaatcaacaaaattggcagcaagcatgcgaccattttgaagctgcgtatcaactagaacagacgttgtcggcgaatttattgtgggccagtgcgctgattgaagctggtgatccgcaaacagcattgacaatcgtcgaagaacaacaagcggactacttacaacaaacagatttagtgcggttttatcttgcattattactgaataaccaccgttttattacggcaaatcaagtgtgggaggcattacgccatgcgacgattgccccgcaagtcattaagacgcttagaatgatgattacggctgcggaattagaataccaagcgaatcaccaagcaacgattcaaaagcaagcagagggcctctataacctcactgcgcacccattagctgaacagctagcaatgttgacgcaggctgaacaattaccacgtaatgtttatgtcaccagtattgcgcccattttaacgaatccttacagtcatgctttcgtgaagacgactgtcattgaaacgctcgtccagctgaatattgaacaattagtcacgatgcaatggtttgaacagacaaaaacttttgtacctgccgatatccaactgatggaggagagcccgacgtttaatgcggtgttagcggcgttaaatgagcagttagccactgaagatccgactttgttagcacaagtgatggcggatgttgagatgggatttgcatatttatatccttttgaagctggaatcatgtataatcccacggagtgggcgcaagcatggctcaaacagttactgggttcggattataccgcgtcagtggttatttcagaaaagacagaggactgggtgaaaaagttgcaagaaatgacagggaaacttgatttttagagtagaaaacacctaaatatcgtttcaaaactgactttttttgagcattaagtgtttacaaacgcgctcatagcagatataatcatttttgaattcttcaagtgtaaaaaaacactttgattttagcgcttgaagtattataatattatgtaaaggattatcagtttagtaaatctaaacactgattttttcttgcgaaaatacaggaggttcgttttaatggcagaaaaagcacattacgaaagaacaaaaccccacgttaacatcggtactatcggacatgttgatcatgggaaaacaactttaacagcagcaatcacaaagatgttggcagacaaaggcttggctgaagctcaagactatgcaaacatcgatgctgctccagaagaaagagaacgtggtatcactatcaacacagcccacgttgaatacgaaacagaaaaccgtcattatgcacatattgacgccccaggacatgctgattacgttaagaacatgatcactggtgctgctcaaatggacggtgctatcttagttgttgccgcaactgatggccctatgccacaaacacgtgaacatatcttacttgctcaccaagttggtgttgactacatcatcgtcttcttaaacaagactgatttagttgatgatgacgaattaacggacttagttgaaatggaagttcgtgaattattatcagaatacgatttccctggtgacgatattccagttatccgtggttcagcacttggtgcattgaacggcaatgctgacgacgttaaagctgttgaagaattaatggctactgttgacgaatatatcccatctccagaacgtgacacagacaaaccattcttgatgcctgttgaagacgtatttacgatcactggtcgtggtactgttgcttcaggtcgtatcgatcgtggccaagttactgtcggtgacgaagttgaaatcattggtttgaaagacgaagttgctaagacaactgttactggtttggaaatgttccgtaagacattggatcaaggtcaagccggcgataacgttggtgctttattacgtggtatcgaccgcgatagcatcgaacgtggccaagttttagctaaaccaggttcaatccaaactcacaagaacttcaagggtgaagtttatatcttgagcaaggatgaaggtggtcgtcatacaccattcttctcaaactatcgtcctcaattcttcttccatacaactgatgttacaggtgttatcgaattaccagaaggtgtagaaatggttatgcctggtgataacgtaacatttactgttgaattaatctcaccagttgctattgaaaaaggccttaagttcactgttcgtgaaggtggccgtactgttggtgccggtgtcgttagtgaaattatcgactaatattcaacctagttgaatcgaaaaactcgtagtgtaaaaactgcgagtttttttgtgcattaaattcgataaaagttggcctgaaacgattaaaatatcgggttttatcgctttttagaccaataaatatttacaatttaggtcaaatagtttatgctaattaagtatgcaattgatagattgtgaatataactgtcggagggaaattatgtcagcaaaatgggaaaaaaagggcaccaatgatggtgaactaacctttgaaattgatttaaataaaattagtgaaggtttggacgttgcgttcaaacgtgtacgtaaaaatatcaacacaccaggtttccgtaaaggtaaaatgccgcgccaaatctttaacaagatgtatggtgaagaagccctttatgaagatgctttaaatgcaatcttaccagaagcttatgatgctgctgttaaagaagctgctattcaaccagttgatcaaccacaaattaatgttgaaaaaatggaaaaaggcgaaccttgggtaattactgctcaagtcactgttaaaccagaagtaactttaggcgactataaaggcttagaagtaccaaaacaaagccgtcgcattacaatcaaagccgttgatcaagaaattgaaaaccgtcgcgaacgtcaagctgaattggtattaaaagaagacgcagctgctgaaaacggcgatactgttgtcatcgattatgctggttctgtagatggcgtaccttttgatggtggtcaagcagacaactattcattagaacttggctcaaattcattcattccaggtttcgaagatcaattagtcggtcacaaagcagacgacaacgttgatgttaaagtaaccttccctgaagattaccaagcagaagaattagctggtaaagaagccatcttcaaggtaacaatccatgaagtgaaagctaaggaattacctgaattagatgacgaatttgctaaagatatcgacgaaagcgttgatacattagacgaattaaaagaaaaaattcgtgaagaattaaaacaacaaaaaaatgatgctgcagatgctgctatccaagatacagccgttgctaaagcaactgaaaatgcaacaatcgctgaattacctcaagcaatgattgacgaagaaatcaacagtcaattacaacaatacttaggtaacatgcaacaacaaggtatcaacccagaaatgtactatcaaatcactggtacaactgaagatgatttgaagaaacaattcgctggtgatgctgacaaacgcgttaagacaagtcttgtacttgaagccgttgtggaagctgaaaacatcgaagcaacagacgaagaagttgctgcagaacttaagagtttagctgaacaatacaacatggaagaagctgctgttcgtagcgtcttatcaggtgacatgttaaaacatgatattggtgttaagaaggcaatcgaaatcattgctgattcagctgtagaagtgaaagacgctaaataaggtcgtctgatcaatccaagctttaaatgatgctaaaaagcgggttcaaggtgtttactttggacccgcttttgtgtcattgacggtgtgcgagtaactttactttattctagaccatagttatgctatagtctgaattacgttgtaggggtgtcttttaacgactcacagcggtaagcgtatatcgagaaaggggagaatcccagtatgctagatgatacagaaacaactaacggacccgtaacgtgttcgttttgtgggaagtcgcaagatcaagtgaaaaagatcgtggctggccctggtgtttatatctgtaacgaatgtatcgacctttgcaaagagattattgatgaacagtttaaagatgaggccttcagtgatttattagaagtgccaaagccaaaagaaattttagccattttaaatgattatgtgattggtcaaacagaagcgaaaaaagctttatctgtcgcagtctacaaccattacaagcgggtcaaccaaatgtcagtgaccgaagaaggcgatactgaattacaaaagagtaatattgcgttaattggaccaactggttccgggaagacattccttgcgcaaaccttagcgcggattttaaatgtgccatttgcgattgcagatgccacgactttaactgaagcgggttacgtgggtgaagatgttgaaaatatcctcttgaagctgttgcaaaatgcagacttcgatgttgatcgtgctgaacgcgggatcatttacatcgatgaaatcgacaagattgccaagaagagtgaaaacgtctcgatcacgcgtgatgtttctggtgaaggggtccaacaagccctcttgaagatacttgaaggaacgattgctagcgtgccacctcaaggcggtcgcaagcacccacaacaagagttaatccaaattgatacgaccaatattttattcattattggtggcgcctttgacggcatcgaaacgattgttaaaaaccgcttaggtgaaaagacaattggttttggaagcaagaatggtcaaactaccaatgaagatcaaagcttaatgcaacaaattgtaacggaagatttaatgaaatttgggattattcctgaattcattggtcggattccgattaccgctgcattggaaaaactgactgaagatgatttggtgcatattttaactgaacctaagaacgcgcttgttaagcaatacagcaagttgatggccttggataatgttgaattagaatttacaccagaagcactccatgcgattgcacatctagcgattgaacgaaacacgggggcccgtggtttacgttcaatcattgaagaagtcatgatggatatgatgtttgatattccaagtcgtgaagacgtggctaaagttgtcgtaacgaaagaagcggtggatggcgctgccaacccacaactctttttagctgacggacaagaagcgtcataaaattaaaaaactgccgggacaaattagattttgtcgcggcagtttttttgcgttaagggacttttgaaatggtgcaatgacgcgatttaacggggttaagaagatgtgttaaccatgaaactagagagatgtcaacggcgcaataattatttatttatgctaaactaacattcgaaggaaataatcggaggttattatggaagtacatgatgttgaaatggtgatgagtgcggtagctgcttcgcagtacccaactgatcaattacctgaaattgcgttatctggtcgctcgaatgtcggtaagtcttcattgattaataaattaatcaatcgtaagagttatgcacggacatctagcaagccaggtaagacacagactttaaacttttaccgcgttgaaaacgaactttactttgtcgatgtccctggttatgggtatgccaaagtttcaaagaagcaacgtgagaagtttgggcaaattatcgaggcttatttaaccagccgctcaaatctaaaggggcttatttcattaattgacggccgtcacgaaccaaccgatgatgatatcgcgatgtacgtttttgcgaagtattatgatatccctgttttagtggttgctactaagatggataagatctcaacggggaaatggaatcgtcaagaaaaaatcatcaaagaagcgcttgattttaatccagtcgatcaatttgtttgctttagcgcactgactggtgctggtaaagagacagtttgggaatggattgaaaagcaatgtgcaatagggggacaagcataatggaatttaatgactatcaaaagttagccaaccgaacgttatatggtaacgaacaagtgttaactaacttagctttgggcttagcaagtgaaagtggtgaagtggttgatatcgttaaaaaatatgcgttccaaggccacgaactagatgaaaaaatgatgtctaagaaaatcggcgatgtgctttggtatttatcacaaattgcggaatggaataacctcgactttgataaagtcgcgcgcgaaaacattgaacaattaaaacaacgctacccagaaagacacgcagaataaagcgtacaatcgcgttaaccgaaaggcgatcgcaaataagcacgtttaaaccagcaaaaaaggcggtaagacaaaaatgaatttgtcttaccgccttttttgctgtctttgtttaatgcttttctttttgttctgcatctaccttttttaatttatcagctgtttcttcaacttgtgcttcaactttttggcgttcttctggtagtgatgcgaatttatcgaataaaccggttaaatcggtcttgttagtgacttttaagcccatcgtaatccctcttttctaatttgcatctatcataccagataataacggtttcgccaatgattcactttttataaataaatattgcataattatttaattggttgtatgatagtcctaatcagaggaggagataatatgacgattaaaaaattactcactttcgttgggttaccattcatggtaatgttaacgtttttcatgattcagcagcagcccgttttggcagctggacagacggttagccaagtgcaagctaaaaaaacgttggttttggggaccagccccgattatgcaccttatgaatttttagtgaataaaaacggtaagaacaagattgtcggtatggatattcaagtcgcacagaagctagctgatgatttaggcgttaagttagtggtgaagtcgatggactttgatgccttattggttggtttggaaaccggtaaagtcgatatggttatttcggcgatgtcaccaacggatgaacgaagcaagagtgttgatttttctgatgtctattatctcggtggtcaatcaatcttagtcaataaagctgatgcgaagatttaccactccaaaaatagttttaacgggaaaaaagtcggggtacaaacggggagtctccaacaaacactcgctaaaaagcaaattaaagatgcgcagattacgggcttggccaaagtcccagatctcgtccttgcattaaagagtcataaaatcgacgggattgtggcggaagaaccagtcgcaaccgcctatgcaagtaatgatccagaactcgttcaaattaacgggaaatttgatttaggcgcagacatgcaaggatcagcgattgcctttccaaaggattcgccaaccttagtcgctgctgctaataagagtatcgggaaaattaaaaagcaaaaattaattccgcaatacttaaagaacgcgggtcaactcatgaaggtcaatacgcacaacactagcatgtggcactattgggcatacttcgctaaagggattggctacacattattcattacgattgtttcaattgcaattgggattttaattggggtcctcctagcctttgggcgtttggccaagaataagttggtgcgtgcgctggcagtcatgtatatcgaatttgttcggggcacaccgttgatgattcaaatcatgtttgtctacttcgggattggtttatgggtcaacattccagcacttttggcaggggtaattgccgtttccttaaatagtgcggcgtatgttgctgaaattatccgttcagggatcaatgcgatcgatgctgggcaaactgaagcttcaagaagtttaggcttgtcacaacgcgatacaatgcgttacattgttttaccacaagcgctgaagaatatctggcctgctttagggaacgaattcatttctttaatcaaggaaagttcaatcgtttccattatcggggtcactgatttaatttatcaactcaaagtggttcaatcagcaacttataaaggcgtcgcaccgatttttgttgcgatggttatctactttatcatgacctttagtctctcgaaacttttgaactacgtggaaaggaagatgcaacatgcttaagattaatcaattggttaaaaaatatggggacaacctcgtgttaaatggtgttagtggtgaagtccaagctggtcaagtgattgttgtcatcggcccttccggtgggggtaagagtacgttattgcggtgcttgaaccgtttagaggacccaacgagtggccaaattctgtttgaaggcaccgatttgatgacgttatctgaaaaacagcttgatcagattcggacaaagatggggatggttttccaaaactttaaccttttccccaatttaactgtcctcgataacttaacattggcgccacaaaaagtgaagaaagaatcagcggccgaaacaacggctaaagcaaaagcgttgcttgaacgcgttggtttagcggataaggcggatgcttatagtgatcaactctctggtgggcagaaacaacggattgcaattgtgcgggcattagcgatgtcacccgacgtattgttatttgatgaaccgacatctgcgctcgatccagaaatggtcggcgaagtcctcaaggtaatgcaagacttagcacaagaagggatgacaatggttgttgtcacccacgaaatggggtttgcgcgcgaagtggcggatgaagtctggttcatggcagatagtcaaattgtcgaaaaagggacccccgaagccatttttgaccatccgcaagaagaacggacgcaacaatttttagccaaggtcctagcacaatagttgcaatttagccaaaaacacgtaaaatagaaagacgaacacttgttttgaattaaaggagtggtgtttttggcaagcgaacacattgaacataaattagcactcttacccgcattacctggttgttatatcatgaaggatatcaatgccaagattatctatgtgggtaaagcaaaaaatcttaaaaatcgcgtgcgctcgtatttcaagagtagtcacgaaggaaaaacggtcaaattggtctctgaaattgtcgattttgaaacaatcatcacatcgacaaataaagaggcctttttgttggaaattacgttaatccagaaacaccaaccttactttaatattaaacttaagcggggcacaggctacccctacattaaaattacgaatgaacgcgatccgcgcctactgatcacgggggatgtcaaaaaagatggcggcttttattttggcccttatccggacgtgtatgccgcccaagaaacattgcgattcttacaacgggtttatcctttacgacgctgtcagggacatcaagggcggccctgtttgtattatcatatgggtcaatgtttgggcgcgtgtttcaaagaagtgcctgagagtgtctatgcggcccaaatcaaggagattaaacgtttcttgaatgggcaagttgatccggttaaaaaagaactgacggccaagatgactacggctgctgaagagatgcagtttgaacgcgccgcagaattgcgcgatcaactccactacattgaagccaccgttgaaaagcagaaaattatttctaacgataataccccgcgcgatttatttgccttttatttggataagggctggttatcgattcaaatcttcttcatccgccaagcacggttgattcggcgtgaaaagcggctcttcccgtgtgtcagcacacctgaagaagaattggcaacctttattttacaatggtacaaccgcaagaataatgtgttaccccgcgaaattctggttccagaaggggtcgaaaagaaagtactcaccgaaattttgaatgtgccgattcgcacgccgcaacgtggtgagaaaaaagcgttgatggaaatggcgcagaaaaatagtcggcttgtgttggaagagaagttccgtttattggaactcgacaaccgcaagaccgttggggcgcaagatgagattatggacgcgcttggcttaccacatggccacgtcattgaagcatttgatcattcgcatattcaagggactgatcctgtctcagcgatggtcacgtttgttgatggtcgtgccgagaagaaactctatcgcaagtataagttaacgcaaacgacagatcgtgcaggcgccaacgaagatgccaatacgcgggaagtcattttccggcggtattcgcgattgctcaaagaggataaaccactgcctgatttgattttaatggatggtggaattgtggagctcaatgcggctaaagacgtcttagagaacgaattagggctatcaattcccgttgcagggatggtcaaggataatcatcacaaaaccgcctcgttgttatatggggaagttgatcaagccattcagttggatccaaagagccaagggttctacttactaacgcggattcaagaggaagtccatcgttttgccatcagtttccatcgccaattgcggggaaagaactccttgagttctaaactcgatgatattaagggggttggtcctaagacgcggacgaaactcttgaagaactttggctcgatgaagcatattaaagatgcgtctgttgaagaacttgaagcactcgggatttctaagactgtggcgcaaacgattaaattatcactttaggcgtgtgtttgaagcggtttgactttgagaattaacctaaaatgggacttatgacgttttttgtcataagccccattttgtagttgtgagttaacgttttttatcgatagcctcttttatctgactggtggaatatggtacgcttatgttagtttgaacgaggacgtgagtgggatgcaggaaaaagcactttttaaaaatggtctcgggattatcattggcgccttgatttatgcggtggcgattaatgatttcctgattcctcatcatattggtgaaggtggcgtgactggcttaacggcgattggctactatgcgttagcaattccgccagctgctacgaatttggttttaaatggtttgttggtgattgtcggttttaagtatttggagaagcaaaccatttggtattcggtctgggcggtactctggatttctatcttcttgcggctcccgcattttatcggctaccatacgacacagacgatcattccgacgataattggtggcgtcttgatgggggttgccatggcgattattattcattgccaaggaacgattgctggtagtacgatcttagcgaagattgccaatcgctatttagggattcaaaacggctctgcgatgctttttttcgatttaattgtcgccattccatccggcttcattatcggcttccaaaatatgctcttaacgattattgaattgtatttatcagcagtcgttttgaataaattattggctaaatttggggcaaaacgcgcggtgacgattatttcggatcaatatgcaacgattgcccaaacattgtcgacacaattccaccagggcatcacgatcattaaagcgcaagggtactatagtcaaaatgaccggccgatgctgtatgtcatttgtacggccaaacaactcgcgacgctcgtaccggtggtctcaacgattgaccagcaggcgctagtagtagtcgaagaagtccgcagtgtccaagcagaacaattgaaacagcttctttagaaacaccgtggttgaccatggtgttttttattcgctaaaattagttttatatagtaatatataattaatgttgatataaaaacaatttaggagttgacgggatgaaaaccaaaaagggtggttatttaacgttgaagattcgcttattaaatacccgactttttaatcgttatttaacagctgatccacgcgcgtgctataacgctgaacaagggaaaattttgtcagcattgtgggatcatcatccgcaaactgcgacggaattggcacaagtgactggcttagccaatagtagtttatcattgatgttgcggcgtttagaggaacagggattattgatgagtgagcaatcgccacttgataagcgcaagcgggtctttgacttaactgaacaaggcgctaatcagcaacaggtcggtgatgacgttagtcaacgattgagcgccgttttttacaagggcttttcggatgctgaagtggcagctgttgatggttatttggaacgaattttagcgaatttagaagcagaggcggccgtttttaaacgtcaagcaaaaggggagcgaaccaataatgacaattgaacaaccaacgcagattgaagtgcgtggcgggaacgtcaataacttgaagaatattaatgtcgatattccgttgaaccaatttgtggcgatttcggggccgtctggttcaggaaaaagttcgcttgcaatggggattttgtatgcggaaggctcacggcgttatttagaggcgttgtcgacgtacacgcggcgccgaatcacgcagaataaacgctcacaagtccaagaagtgcggcatattccatcagcgattgcacttcggcaacgaccaagtatgccatcagaacggtcaactgttggttcgatgagtgagatttttaatgtcgtcagattgattttttcacggttagggacgacacgttgtccaaatgggcacgtgattcaaccaagtctaaaaattgcccaagcgatggacttagctggcgataaaatggggattattacgtgccctacttgccaagtgcagtttatggctaaatcggccgaagactttgcctttaattcagctggcgcctgcccagaatgtcatgggacggggcagattcaaacgttagatgatcgcaaaatcatcgcggatgaaaatctcagtattgaagacggagcgattgcctcatggcgattgccgggccggaatttcatgccaaccgttgctgcccacattggggtccgaattgatgtcccttacaaggacttgacggccaaggaaaaagaaattgtcctgcatggtaaacgggcgaagtatgcggttgatttccatacctcaacgggccgtgtgtttagtacggagaataccctctatgaaaatgcttatgacgctgtttatgaatcgctaaaatcggttaaaagtgatcgggcaatggctaaagtcaattcatttttccatttttcaacctgtccaacgtgtcatgggacccggttaaatccggcattactgacccaaacagttggcggacaaaacattgcagcagtttctaatttgacgttaggcgcattagaagattgggtgcgtgctactaaggccgacttaccggatgaaatgcagcaaatggcgacaattttatttaagaacctattagaaacactgcaaccgttactagaattagggttggattatttaacgttgtcgcgcaatgggaatacattgtcgactggcgagctccaacggattcaattggcgcggacgttgcgaacagcgacaactggtgtgttgtacgttttagatgaaccatcgattgggctgcatcctgacaacgtcgaagggctaattcatattttccggcagctagtggcacaaggcaattcgttagtggtagttgatcatgaagtgaatatcatcagtcaagcggattgggtgattgaaattgggccagaagctgggcgcaaagggggacaagtgattgcccaagggaaacccgcggatttgatccagaatccacagtccctgattggccactatatcgctggtcgagcgaacatcttatatcctaaagtcactgctgtaacgactggtgagtagacaacgatgacggttggccaatattttaatctgcatgatgtcacaatcaaagtgccagataaccaaattacggcggtttctgggttttccggcgccgggaagacgagtttgattctagatagtttagtgccagcaattgaagcgcaccaccaacatgagcaattacccgagcaggtcacccagttgacgaccgatttaacgtcagtcgtcagcattgatgccaagccggttggtaagaatacacgctcaacactcgcgacttatacgagtatcatgaacaatctgcggaaattatttgctggtttaccagaatcacaagcgcatcattatgggatcgcgcacttttcgtataacaataaagaaggcgcctgtccgaactgtggtgggttaggcagcattattttggatattcaatatttgccagacatggaagaaacctgtccagaatgtcatggtaaccgctacaaaccagagattgaagccatcaagtggcaaggctatagcatcgttgatctattggctttatcggtggaagaagcaatcccggtctttgcagatgtgccagcaattcaaaaggaacttaagattcggcggggctttttattttgggttaaaaggcgaccagtacgcggccagttttatgcgtcttttggctaagttcttgggctaaatcagaaaaggcgaccaagttaactgttggccaaatttccggtttaaacgtcgtggcgagtaattgccagagttctttacggtctttgcgcgggtaatagactgaatcaattccggctaaggtaatcccacgtagaataaacggcatcaccgttgtttcgaggatcgcaccagcggcattgccacaagttgctacgaatccgccggcacaaacttgcggtaagatatgggctaaaacaggaccgccaagcgtatcgatgaccccggtgaatgtctgatggctgagcgctttaagcgggccagcagttaggtcagctgtattaataacatgggtcgcaccaaggtgcaataaataatcggtttgctgcaagtcacgcgtagttgccgttagatttgtgaagccaagctgtgcgaggatggtaagtgcgaaacttccgactccgccagtggcacccgtaattaagagtggggtgtcatgatcggctgtaaaggtttggcgtaataatttgctgagcgcaattgcggcggtgaaaccggccgtcccaaactgcatcgtttcagcaagactaagattttcgggcaacttaaagagccattcactagggactttaacatattcagcgtagcccccagcgattgtaatgccagtttcataacccgtacataacacctgatcgcccgcttcaaagaacgggttatccgattcgacaacttcgccagcaaaatcaacgccaggcgtcatggggtagtgacgtaagacgccacttttaggattcatagtgagccggtctttgtagttaatatcagaataggcgactttgactaacaccccgtctttagcgaggtctggcgttaacttagtttgataagtggcactgacagtagtgtcggtttgttctaaaacgagtgcttgataggcgaccatatgattacaacctcatttctaaataattatttaactccattatacaacaatgttcgctttaaattggcatcgcgtctcggaaacggtataattaatagaatattagtcaactaataacgagtctgagagtgctaaagataaaggggacgaagaagaagatgcaacaaccaatggtggaatttaaaaatgtcattaaagaatacgacgatgtccaaattttaaagggcatcgacattgcgttggaaaaaggtaagttttataccttactagggccgtctggctgtggtaagacaactattttaagaattatcgccggatttaccaatgcgtctgccggggatgttttatttgaagggcagaagatgaacgatttaccggccaataagcgccaagtcaatacagtttttcaagattatgccttgtttccccatctaaatgtctttgagaatgttgcatttgggttaaatctacgtaaagttaaaaaagcagcgattaaagaaaaagtgattgaagcccttaaattggtgcgtcttgctggatatgagaatcgcgaaattagtgagttatcaggtgggcaacaacaacgagtagcgattgcgcgcgctttggccaatgaaccaaaagtcttgctactagatgaacctctatcagcactcgatatgaaattacgaaaagatatgcaatatgaactacgcgatttacaacaacgattagggattacgttcttatttgtaacgcatgatcaagaagaagccttagcgatgagtgatgaaatttttgttatgaacgaagggcgcgtgttgcaaagtgggacccctgtcgacatttatgacgaaccgatcaaccatttcgtagccgattttatcggggaaagtaacattctgccaggtaaaatggttgctgattatcaagttgaaatggttggcaagcagttcgaatgtgccgatgccgggatgcgggtcaacgaagcagttgaagtggtgcttcgtcctgaagatctagacattgttgccgttgaccaaggccaattagtggtaacagttgatacgcagctattccgtggtgactattatgaaattacggcctatgatgcggatcaaaaccggtggttgattcattcaactaacccagctaaagatggtcaacgagtcggcttattctttgaaccagaagacgtgcacatcatgcgttttggggaatcagaagaagatttcgatgcacgacttgaaagttacgaagaggaggactaaggcaattgcgtaaaaaacaatggttatattacttaccatatgccctgtggctaattttgttcgtcctcgcaccagtcgcattgattgtgtaccagtccttttttgatatcaatgggcatgcgacattggtcaactacacgacctatttccagtcaggcacttatttgaagatgacattaaattcgttatggtacgcctttttaattacgctgattacgctattaatcagttatccgacggcgtattggcttcatcaaacgaaacataaacaactttggctattattaattattttaccgacatggattaacttattactgaaagcttatgcgtttatcgggatttttagtcaagatggcgccattaatcatttcttggggtggttcgggattggaccacaacagattttatttacgaatttcagtttcttagtggtggcgacttatattgaaattccgtttatgattttgccgatatttaatagtttagaagaattgaatccatcattggtcaatgcaagtcgtgatcttggcgcaagtaattggcaaacctttacgaaagtcatcttaccgttaacaatggctggggttaaagccgggatacaggccatctttattccatcgttatccttattcatgttgacgcgtctaatcgggggtaaccgcgtgattacgctggggactgcgattgaagaacacttcctcacaacaatgaactggggaatgggctcgaccatcggggtagtcttaatcgtcgccatgggcttaatcatgctggtaaccggggagcaaaaagcaaagaagaaggtgactaacaaatgaaaaaaatgaaatggcaaaacgtttggttagtgcttgtctttgtcttattgtacgcaccgattttctatttgattttctattcatttagcagtggggataatatgaatggcttcaaggcatttacctgggcaaattatcaggccttgtttgaagatactcggatgattgaaattgtgttacaaacgttattaatcgcgattctatcatctttatgtgcgacgattgtggggacgtttggtgcgttagggatttattcaacgaagcaacggcgtgtgcgcaatatgattttatcgcttaacaatattttaatggtttcacccgatgtcattatcggggcaagttttttaattttcttcacgttcttaggttttggtttgggctttggttcagttttactgagccatatcgctttttcaattccgattgttgtcttgatggttttgccgaagttaaatgaaatgcggccagcattagttgatgcggcacgtgatttaggtgcgactgactggcaagtcctgagtaaagttattttaccgtacattagttccggcatttttgcaggctttttcatggcgttcacttattcgctagatgattttgccgtgaccttctttgtcactgggaacgggtttgaaacgctctccgttgaaatttactccagagcgcgtcaaggaattagtctagaaatcaacgcattatctgccttgatgtttgtcttctccttaatccttgtggccggctactatttattgaatcaaagaagccaagcccaaaaagtacggcgtaaacggaaagcgggggcttaaaatgaataaattaggacgcatcactttagcgattttagtggtctgtgcagccctttggtttgggacggttgaattacaaaaatcacaaggttatacgaaaaataatacattaacattatataactggggcgattatatcgacccagcacttattaaaaagtttgaaaagcaaactggttatcacgtttcggttgagacgtttgatagcaatgaagcgatgtacacgaagattaagcagggtgggactgcttacgatttagcggtgccaagtgagtacatgattgaaaagatgcgcaaagcacacttacttaaaccgattgatcatcgtcgcttaaccggctatcagaatatcggcaaggattttttgaatcaatcatttgatcttgggaataagtattcattgccttatttctggggtacgctcgggattatctacaacgatcaattggttaaaaaaccactgacacattggtcagatctatggtcaccagattatcgcggccaaattatggtggtcgatagtgctcgggacatgatggccgtgggcttaattgaaaatggccagtcagtcaatagcacgaatccggcggttttaaaggcggctaaggataagcttgatcagatggcaccaaatgtcaaagcgattgtagctgacgaaattaagatgtatatggttcaaaatgaagcgagtgttgctgtgacttggtccggtgaagccgccgagatgttggataataatccccatttgcactatgtaattccagaagagggcagcaatctatggtttgataatctagtgattcccaagacggcaaaacatgaaaaggcggcctatgccttcttaaactttatgttagagcccaaaaacgcggctcaaaatgctgaatatattggttattcaacgcccaatataccggccaaagcactcttgccagcagcaacacggaataacccaggctattatccaagtcaaaaggtgatcgatcgcttgcaagtttatagtgatttatcaccaactgcggttggccgttataatgatttatttttagagtttaaaatgcaacattaaaagtacaatgagcagattgaaatggttcatggtataatagatacagaatttttttggatggaggttacctatgtcatttgaatggtcacagttattaacgtggcggatgctcgcaaatgtgctagacatcatcgttgtctggtattttgtgtataaattaatcatgttgattcgcggtaccaaagccgtccaattgtttaaaggcattatcgtcattgcgctgattaaggttatcagttggtacattggtctacgaactgtttcgtacattatggatcaatttatcagctggattgtgattgcgttgatcgttatttttcaacccgaaattagacgtggtttggaacatatcggacgtggatcgctactacgacgcggcgttaatcccaagattgaacaagaaaataatttaattaaagccctcgataagtcgattcagtatatgtcgaaacggcgtatcggggcgctgattacaattcaaatgaataccggtttggaagattatatcgaaactgggattgatttggatgcggatgtgacgggggagttattaattaacatctttatcccgaatacaccattgcatgatggggcggtcataattcgcgatgataagattgccgttgcggccgcttatctaccactttcagagagtaatttaattcccaaagaattagggaccagacatcgggcagccgttgggattagtgaagtaacggatgctttgacgattgttgtttctgaagaaaccggtggtgtcacattaacgcgcaataacgagttaatgcgtgatttaagccgtgatgattatatgaagtacttcaactcgcatttgattacccaagaggaaaacaaaacgagtctcttacaagaatttgttgatggcttcaaaaaaggaggccagaaatgatgaaaaagtttgttgaaggcccatggctctatcgaattttagcgttatttctagcgttgttactgtttggttatgtcaatttggatgaaattaacacgacgcgccagacgaataacaatgatacacagatgctagcaacccgcacggaaaccgtaaaagtgccgctccagattaatgcggatactgatcggtatttcattaccggctatccacaaaaggtcaaagtgaaattatccgggccgaatgcgctagtcacatcagcagttaacacattaaatttccgcgtgattggcgatttaacgaagctgggtcctggtgatcacaccgtcaagttaaaacagacggggattaataaagatatcaaagtcacgattgaacctaaagaaattaaggtccacattgagcacaaagtgacaaagcaattccctgtgcaggtcaatgttaagaaagaaaacttagcggccgggtatagtctaggaaatccaaaactaagtcaagacgtggttgaagtcagtggtgcaaaatcagcagtgaatgctgtgtcgcaagtagtagccactgttgatcccgatgaaggcaccaaaaaagacatcaatgaagaagtcttgttgcaagctgttgatcgcaatgggaaagcgttaaatgttttaatttcaccacaaaccgttaacgttaagatattggttcaaatgagtaagaaaacactcccgattagtttggaaaagaccggtgaaaaaagtggctacagctacagtctgtcatcaacaactgattcagtgaccgtgtatggtcgtcaaacagctttagccaagttgacgtcgttaccagtgagtgtcgatttatcgtcaatcacgagttcaacttcaaagacggttaaagtggctttaccacacaacatttatgagagtacgccaagtgccattaaggtgacaattacggtgactccagatacgaccaatacgagtgctactaatactgttgaagcgccgtctgaaagtacggcacaaacatcaagtagtgcgcccgttgagtcaagttcaagtaacagccaatcaagtagtcaatcaagctcaagtgaaagtagtaaagcaaataccgatgtaaatcaataatcaacgctaaagattttagcaggatgaatggagataattaaatatgacaaagtattttggaactgatggtgtccgtggcgttgccaacttagaattaagcccagaaatggcttttaaattaggacgtgcgggtggttacgttttgaccaagcacgctgataaggatcaacggccaaaggttttggtggctcgtgacacacgtatttcaggccaaatgttagaacaatctttgatttccggcttattatcagttgggattgaagtcttatcattaggcgtggtgacaacacctgcggttgcctatttaattaaggttcaagaagcaagtgccggcattatgatttcagcctcacataaccccgctatctataacgggattaaattcttcggcgcagatggttacaaattaccagacgcaactgaagaagaaattgaagcaattattgatgccgaagaagatactttaccacgtccagaaggcgctggtttggggacggtagaagaatatccagaaggtgctttgaagtatacccaattcttggaacacacgattcctgatgatttagcggggattaaagtggcattggatggcgcaaacggttcaaccagtggtttgattagccgtgtgtttgctgatctagaaacagaatttacaacaacggcaacccatccagatggtttgaatatcaacgatggtgtcggttcaacacacccagaaaatgttgctaaaagagtgcttgaaacaggcgcgcaagttggtttagcatttgatggtgacggggatcggtgtatcgcagttgacgaattaggtaatattattgatggggacaagattatgttcattctcggtcaatatttatctgataagggtcgtttaaaacaagatacgattgtcacaactgttatgagtaatatcggcttgtataaagcgattgaagccaacaacatgcaatcagtccaaacagacgttggggatcgtcacgtcgttgaagaaatgcgtgaaaaaggctataaccttggtggcgaacaatcaggacacatcatcatctttgattaccacaatacaggtgatgggatgttaaccgggattcaactcttaaacgtcatgaaacaaactggtaagaagttatctgaattagcagcccctgttcaaacttatccacaaaaactcgttaacttaacagttaagaacaaggatgcttggttaacaaatgacaagatccaagctgccattgataccgttgaaaaagaaatgaatggtgatggccgcgtcttggttcgtccaagtgggacagaaccattgctacgagtaatgtgtgaagctgcaacagaagaaaaagtaaatcaatatgctgatcaaatcgcagcggttgttaaagctgaaattggcgcataattaaagggagtgctgacgcgagttggtcaacttttgagcactagcttgaaaagcacgttctcacttgaatcaaactaaaaaagcccgtcaacattgtgttgacgggcttttttggtgcaattttatttaagagcccattcttctaacgcaatgtgacttgttcgtacatcagaaaaccaaagacaaccaataagacaacagcagcggatatcagataccattctttgacaagtatgataggtgcatcagtcaaatgataatttttgcggtaacgtttgagattgaaaacactgacttcattcacgatgattaataaagcgggttctaatagtagcatgtatttactaccggttgaatcgacaatgttattggcggcaatatgtaaggcgattgttttaggtgcaacgacgataaagctcagtccgactaataggccaagaagagaaatacttcgaattaacaagatgctctttttcattacagaaactccttttctaaaattgactggtcttagtatagcataaaagcgctagatagcggaaaatatttggactataccaaaattataaattgatatataccaataaaaatgttgacattaaaatcgttggtgctattatatttaagtgttgtaccaattgattaaagaatattaaaccaaagttgaaaagaggatttttataatgtgtggaatcgtaggcgtaattggcaatgaaaagacaactgaaattttattaaacggattagagaagttggcgtatcgtggttacgattcagcgggcatttacgtgaacagcgaaactgggcatgactacttagttaaagaacccggtaaaattagcgttctagaagcagcggttgggcctgaagtacaaggaacaatcggtgttggtcatacgcgttgggcaacgcatggtgttgcgagtcgtgataatgcgcatccgcatgtttctgaagatggtcgtttttacttggttcacaacggcgtgttaacgaactatttagctttaaaagaaacatacttggaggatgtccattttgtcagtcaaaccgatacggaagtcgctgttcagttgattgcttaccttgctaagacagaacaattatcagctaaggaagccttccggaaggctttaacgttgattgaaggctcatacgcatttgtcatggtcgatcgtgatgatcctgacaccttatacgttgctaagaataaatcgccattgttaatcggtgtaggtgatggctttaacgttgtgtgctcggatgcattagcgatgttgaatgaaacaaaagattttattgaaatccatgatcgtgaaatggtgacactcacgaaacaaagtgttcaaattgaagatttagacggcacttttattcaccgcgaaagctatcatgttgaaatggatgctgatgcagcgggcaagggcacatacccccactacatgttaaaagaaatcgacgaacaaccagctgttatgcggcgtttattgaacgaatacgttgctgttgatggagagcttaaaatcgactcagcgttactcagtgcaatgaatgatgcagatcgcctctacatcgtggcggctgggacaagttatcatgccggtttaatcgggaagaccttgtttgaaacattaacgcacaagcctgtcgaagtacatgttgctagtgaattcggctatcacatgccgctattatctgaaaagccattctttatctttttaacacaaagtggcgaaactgctgatagtcgccaagtgttggtacaaactaatgccttgcattatccaagcttaaccatcactaacagccaagggtcaacactttcacgggaagctgattatacattattattgcatgcaggccccgaaattgcggttgcttcaacgaaagcctacactgcacaaattgcagttgaattattcttagctgttgcactcggacgccacaatcaactggtgctagcagaacaattcgatgtacatcatgaattaggcttagtcgctactggcatggaagctttattgagcgaaaaagaacagattgaaaccttgacgactgattacttacaaacaacacgcaatgccttttatattggtcgtggtgaagattacgccttgagtttagaagctgctttgaagttaaaagaaatttcatacatccaagctgaaggatttgcagccggcgaattaaaacatggcaccatcgctttgattgaagaggggacacccgttattgcattcttgatggatgctaaaacgattgcgcacacgcgtggtaacttgcaagaagtgactgcgcgtggggcaaaagccttgacgattgtcagcgaagaatctgctgaagcagatgatcagatcattttaccaaacgtaaacgacttattgacaccattattggggatcattcctggtcaattaattgcttactatgcaagtttgcatagagggtatgatgtagatcagccaagaaacctagctaagagtgtcacggtcgaataaataatattcaaaaagcctcgttcaaagaacgaggcttttttgcgtttaatgagttggtgcatatgttgctcgtggaccgccaacgtattttggtcgtgaccgtaaagctgtgacatgtgcactacccaatgtatcaagggttgggcggacagggacttgaacgaatttcacgtgcatcccaatcgccgtatcaccgatatctaatccagcttgtgcaacgatatgttcaacttcaaccggatcactgaattgttcaaaagcagcgacggagcaggcgcctccagcgtgcatagcaggaacaactgagacaatttcaaagtcgtgtgcgcgggcaacctgacgttcaatcaccaaactacggttaatatgttcacagccttgcacggctaaatgaatccccaatggattgagaatgccacgaagtgttgcgatgatgacttcaccgacttctttgctagaagccttaccgatatgaccaccgacgacttcactcgttgaacacccgaggacgaacaaatcatcatttcctaagtgtgcttcgtttagaacatcctgagtcatctttgttaagtcttgttgaatttggtttaattgtaattcgtttgtcatttaaaaaatctcctagtggttaaataattgtggtcgaatacgggataaactagtgactaacgggatggtaaccacgataccaagtccattttgaacaatattactgaaaatcgaagcgattccggcagcccagccgaaaagtaaactggtagctaaaaagtaaccggcaaccatgacgatactaccgcaaatgagggggataatcagctgctttggtcgcattgaatcattacgagtcaggtgacctacaacgaagccttgccccccatgaatgatgagtgagaagagacaccactcagggtaaccagataatagatcgattaataggccactcagggctccgacagtgagtccgccaggatttcgcagcatgatcgccgttgtataaataccgacctcacagagcgtcacaaagcccttcgtcgccggaatcgggatgatgattaacaaagagagtgccacggtcgatgcggtgagcatcgcgagtaatggtaattgacgtttattaaagtgcatgtttagtagccccctgccagacattccccaggccatggcgtagatgaataccatcttttaaaccggcataaacaaatttctttgcgcgtgccacggcaacttcaatcgattttccttgtgctaattccgccgtaatcgctgccgaaagcgtacaaccggcgccattaatggtagttgtttccaatcgtggagcttctaaataatgggttgttgcgcccgattttaataaatcaacggcctgttcaccagggaatcgttgaccacctttgataatgacgtgcttggggccaaatgattggataattgtagcagcttcgaccatttcctcacgcgtggtaatcgacgaaaggccactgagttgttgggcctccaacaagtttggggtgacaacgctcgtcaaaggcagtagttctttttttaacgtatcgaggtacgcttgctgcgcaggaatggcgccttctttaaagacgaggaccgggtcagcgatgatggttaattcaggatgctgtcgtagtcgctcacagatggcttttaaagtttccgtttgatgaaccaaaccaattttaacgtgcgttagtggcacgtagtttaaaatggcaccaagctggtccaaaatggtatcctcaggtaagttgtggattttcaagtgaccgtctggtagcaatgtagcgatgcaagttaaggcactgaccccaaacgtttctaaggcctcgaacgtttttaaatcggcctggatgccaccaccacccagagtatcagagccggcaatggttagaatgttttgcatagttgtcctccaaaattctattcttaactatcatagagaagaatagaatgttcaacaacagccaattggcttgtttttttaccatccaatttgtaaactaaataagaggtgttaaaaatgattgaatggttacaatatttacctgaacaaaagccaaagtatatggcaattaaaaaaatgattattagcttgatagataaaggacaattaagttcaggtgaccaattaccgccagagcgtcagttagctaaattattgagtgtcaatcgttcaacggtgacacgtgcgtctgatgaattggttgcagatggcgtgattgaacgtcgcgttggtagcgggacgtttgtcagccagcaagcgcgaccacaggcaaggcgggtcaattggcatacttatttgatcagccaacgtcagtcacaaagtcaaaatgaacggcgccaattacaacaactgattagacgaaaacctgaaaagttaattgatgtttattcaagtgacttaccattagcattagtcccacaatttcaatttcctgcattgacgtggcaagattttattactgcacaagcattagagacaccacgaggctatcaaccacttattacggcaattaatcaattggatcaacacaataaacggctattttttaccgaagagcagttattaatgactgctggtgtgcaacaatcactctttttaatattacagggtttattgacgccaggtgatgctgttgcaattgaatcaccctccttttttcatgactcaactttgtttgaagcgactggtgtccgtgtctatgaagcttcagttgatgctgatgggatttctttgactgctttagaagcgctaatcattaagcaccgtgttaagttggttattctcaatccagattatcaaaatccaacggggcacgtaatgagtcttcaaaaaagaaaagcagttgttcatttatgccagatgcatcaaataccaatcgtagaagatgatgtcttcggttggttaggctttgatacaactaggccaatcccaacgttaaagcaacttgatccggataatgttatttatattagttcgttgtccaaaattatgggggctagtagccgaatcgggtgggtagctgctactccgcaagtcatcgaacagttgacccgcgtgcaacatgaaatggatttagtgccaagcattatggcgcaagtcatggtgaccttagcgatgggggatccgcaatttcaaacgcagttggatcaacttaaggggacgcttcaagaacgtgcacaagcaacctataagatgcttaaaagggtattacccgattggcacgtttacttaccagcgggaggttattatatttgggtgacccatccgaaccataaattacgcttaaaaacctttattgatcatcagcttgctgttgcaccaggatcattatttgggcttaaaacagatgcgttgcgcatcaattttgcgcgattaaatgcaattggtttggtcgcgctagaacaacgattagcagccattattaaagcaacagaataaagaggggggattcggatgacagagcaattcgtaccagagatttatacaccattaaaaaccagtgttgtcggaccacctgctgtggcgcgacaagttggggggattaagatcctcggtaagaagattaaaacaattatttttaccaccgatgttgcgattgtgaataatacaaatgctgacgctgttttggcagtttatccatttacaccacacccagccgtcatgaatgccatcagcaatgtggcgacgatccccgtttttaatgggattggtgggggcttaacggccggcagccggtccgcgtacatgggattattggcagaggccgccggttcgattggcgtggtggttaacgcaccgacctcggtggagacgattaaaatgattaaccgcgttgttgacgttccgattatttgtactgttgtgtcagaacgtcaggattacgccgcgcagattgaagctggagtttcaattttaaacgttagtggcgcggctaaaaccccagcaattgttagcgcaattcgccaacaatatcccgaaattccgattatggcaactgggggtaaaaacgaagctagtatattagcgacgattgaagcgggtgcgaatgcattgacgtacacgccaccgaccaatggcgagttatttgctaagaaaatggccgattaccggtctgatttagcatgataacagttgacgtgctatgcaatcccccgtatgataaaaagattactagaggaggttcttgaatgattcgtcaagcaacagttgcagatgccaagagtgtcttgccaattattaatattgtttttgaagaaatggaaatgccactcttccaaaagattccgctagaggatttgtttagcattttagaacaggcctttgcaatgcctgaatatcggtatagctatgctaacacactagtttatgaagaagacggccaagtattagggattgttgtaggcttcccagaagaaaaggaagcccatatcgacgatgcattagcaccgttattcccacaaatcggcttacctgagacaacgcgtttctttaccgataaggaagcacaaccgggggaatggtatttagatacacttgccgtcgctgaacatgcacaggggcatggtgtagggacgaagttacttaaggccttaccagattatttaaaagcacgtggtgaaaaaaagattagcttaagtgtggatttacaaaatcctggggctaaaaaactttatgaacgaatgggttttgttaaacaaggagatttaatgattggtgaccatcaatatgatcatatgattaaacagctttaacacgaaaagagccgacaacaattgttgtcggctcttttcagattaaagtaatggcataatcattgtcgtccgtagccagctcagtggcatgactaagatcattgctggtatcatgtctgcaattggaaattcgcgaattttagcaattctaaagccagtggcgagcatcaagaggccgccgcaagctttgaaatctgcaagcattgttggatttgttagtgggaagatgagtttggcgagtaagaaaatgatgtaaaagataatgaattgcggaatcgcaatggttgaaacgacggggccaagattgcaggcaaagatggcagcagtaaagaaatctagaattgatttagaaattagaatcgtattgttgcctgtcataccagcatctaatgtcccataaataccggtcccaccggcacaaaagaggacaatcactgtcacgagtgctgaaataaattcggtatctgatagcgtattgtttttacgcggaaaaatttagaaattggccgttccatcaagacggcaccgcgaccaatccagcgaccgaagtgaacgagtaggccaatcccagtaccgagaacaactgcgaagatgactgcaggcatgttcttcatttgaataatggcattgatgcccattcccatcgaagcaacaccgaagattaaggtgagttctgttttaaatttagttgataatttatctcccaataaactaccgaatagaccgccaaataagacggctaatgaattaataatcacgccagttggcattgagaagacccctttaattttaagtttgcatattcaaccataccaatttaaaagaaaagaatcaatttaattttaaatgttagcgcttatatatattcgatgggagtcttgagctagaccaaaaaacgactaatcatttgattagtcgtttttttactgactattcgaatcgcaaactaggcttaaaacgtcgaatcagtgccttgggttggttataggcccaatgatttaaaacggcggcaatcaaaatacaggggacgatatccttttcttggttgacagtcaattgaaaggctggaccgctgcttgctagaatggtggtcgcttgcatgatgggttgtgtatggtagagaatgcgatattgattttgcgttaaatctcccataattaaccaattaagttgtttgacatagacaaactcatgccagatgccccagatctttttgagttgaccaatccgttcatcgttttggaaaaggtcaaagtcaggtgaggggctaattgtgacttggcgaatttcaccgagtaagtcgccggtgagtgagtaaaggctgaatacgtcatgccgaatcccacgttttccaacaagtaaataacgcggttgttcttgatcgtcaatcacggttgagacaccacgtgaagcactagcctggtgtttaatgtagaaaataggcatcaaagatcacttcttttcagctgtacgattcaagtcaatcgcgtgataaatcgcttgtgcgacgccgtcttgaatgttagttgcagtttgatagttcgcaagttccttaattgttgggacagcattgcccatggcgacaccaatgccagctgttttgatcattgaaaaatcgtttaagttatcaccaattgccattgtttgctcaactggaatccctctttgttcagcataggcggccaaagcgatgcctttttgagcgtcaatgtggtttatttcgatgttattacttgaagaggaagttacaactaaatccccgcgggcttcacaaaaggccttaattggtgctaattcggtcattccctgtgtgctaaaagcgatgattttaagaatcttaaccgttggatcgttaataatcccttgatagtgatcatcgacgtagttaatattcattaattccaaacgggctgctgctaaagcaaccgcaattttataactcgtatcgggattgaggttgacgagtaaatcagcgatattttggatgcgactgactttactatctgaataattaccggcagtcgtcatgagttcgaagtaaatattattttcgcgtaaattttctgtgacggctgtcaccgtttcggaatcaatcggcacattcaaaacttcattacctaaagaatcaaaaatttgggcaccattcatcgtaattaaagtaggttggatgtcatcactgtcaattagggggagggcttcagaacgactgcggccggtagctaccacgaattcgatgccggcgtcttgggcagctttaatggcggtcatgttaccgtctgaaacctgcattttgtcgtttaataaggtaccgtccatatcagatgcaataattgaaatcaaaggaattcctcctgaaaacgtattattagaaacttacctctatcttagcatgcaagctacttttcttctagcaacttatgttaaaacacgataaactagttaatgaggtgagcagatgaaaacaattattcacaatgagtggcaaacgattctcgcaccagagtttgccaaaccctattatggtcagctccatacctttttgaaacaggaataccaaacgaccacggtttatccagagatgcaccatattttccaagcctttgaatggacaccgtttgaacaggttaaagtcgtcattttaggacaagatccttatcatggcccgaaccaagcccatgggtgtagtttttccgttttaccaggggtcaaagtcccaccatcattgcaaaatatttataaagaattgcagacggatgttggctttcaaccggttcagcatggctatttaaagagttgggcggaccaaggcgtgttcttgttgaacaccgtattgaccgtgcgggcaggtcaagcaaattcgcatcgtaaacaaggttgggaacagctaacggatgcggcgattgctgcattgtcaaatcggggacatgtggtcttcattttatggggaaacgcggcaaaggataaacggcggttaattgatgagacgcaaaatgcggtcattactgcagtacatcccagtcccttgtcagcctatcacggtttctttggctctaaacctttctcacagacgaatactgcccttgagcaatggggcatggcgccaattaattggcaattaccacaaacagtcacggtagaataatgaagcgttaccattgttgacttgtcgcggtattagaaacgttgtatgattacattagcaataataaaatgcttactggaggttgcaattgtggatttatttgaaagcttaaaagcaaagattaccaatcggcaatttaaaattgtttttccggaaggaacagaaccaagaattattggtgcagcagcacggttgaatgctgatcggattttgaaacccattttaattggggcaacgaatgatattcaacaaatcgctgctgctaaaggatttaacttggacgggataacgattattgatccacaagaatatccaacagctgactttgaaaaaatggttgccgcttttgtcgaacgccgcaagggcaaggcaacccctgaacaagcacaaacaattttacaagatcctaattattttggcaccatgctggtttatttaaacttagccgacgggatggtttcaggtgccgtgcattcaacaggtgatactgttcgaccagcattacaaattattaaaacaaaaccaggtgtccaacgcacaagcggggccttcattatgcaacgcggtcgcgataacgaacgttacttattctcagattgcgccatcaatattaacccgaatgcgcaagaattggctgaaattgctgtggaatctgcaaagacggctgagttgttcgatatcgatccgaaagttgcgctgttgagcttttcaacgatggggtctgcgaaagcagacgaagtcacgaaggttcaagaagcagcacggattgcacatgaaattgcgccagaattagacattgatggtgacctacaatttgatgccgcatacgtaccagttgttgcgaaccaaaaagcaccagattcaaaagtggcgggtcaagccactgtgtttgttttcccagaattacaatcagggaacattggctacaagattgcccaacgttttgggaatttcgaagccatcggaccaattttacaaggtttgaatcaacccatttctgatttatcacgtgggagcaacgaagaagatgtttacaagttagccatcattacggctgctcaagcattacaaaactaattgactgacaataaagacgccagcacagaaaaattgtgctggcgtctttgactttgcgaacagggcttttttcggtataatgacacacagataacaattagaatgaggcagaacatgttagaatttaaaacaactgatccagaacaaacaattgcgattgccaaacagttgggccaacaagtccaagccggtgatgtcttgttgttggatggtgatttaggcgctggtaaaacaacgtttacgaaaggattggcagccggtctgggaatcgaccgctatattaagagtccaacgtttacgttaattcgtgagtatcaagacggtcggttaccactctatcatatggatgtgtatcgattggaagaaacgggtgctagtgatttaggcttagaagagtatttcgatggggacggggtttcggtgattgaatggagtcaatttattgctgaagaactaccgagcgattatttgacgattcattttaataaggatgttagcgatgatcaagttcggacgttagtacttgatccgcacggcgctcactacgaagcattggtgcgtactagttttgcagactagtgtaattgacattcggcccgcgcaagcagcagatgcgcgggcttatttatgttttttaaaggcggtcgctaaagaaacaccgtatgttgcgttaccagcggagttagccacttcaacaccattatttactgaatttttgatagcaagtattcttgaatcgcaacaagatgtattattgcttgcttttgatcaacagcaaattgtcggggcaattcgtgtgaatagtcccacagaacaggggctaacacatatcggtgaagttagtatcgctgttttaaaagcgaagtggcatcgcggaattggctctgatttgatggcgcaccttttagcgtcgattcgagaaataggaaatccgcgacggcttgagttaacagtacaagcccgtaatcaccgtgcaattgcactttacaaacggtttggttttgtgaccgaagcacaattagcagcgggattttatgcgccagaaacgggctatattccggttgtgcaaatgtgccaattaatgaatatggatgaggagatttaagatgcaacaacaacgaggacgcggaatttacttagccgtattaggatcaatattttgggggattcaagggccagtatcacagtggctattcactgacacggcaattaagccagaatggctaatgggggttaagattgggctttcaggcctatttctattaggttatgcgctcattaaacaaccgaacgatgtttttacagtgtggcggcaaccgcgggactttacgcggatgttattatttgcagtattagggttatcggctgttcagtatttttattttctaacgattcaagccagcaatgcaccaacgactacaattctacaacagctaggcaccatcatgatcatcttaattagcttggtgatttatcgtagagcacctagccgcgttgaactaattgcagtgactgtcgcattgttggggacgtggttgttagtgacaaaaggacaactgacgcatttggcgatttcacacgcggcattcggacttagtttatgccttggcttttctggcgctttaaacacattaattccggttaagttattccaaaaatatccaacattagtgattgtgggctgggcgatgttaatcggtggggtggtcttcacatttgttcatccattttgggtcggtgttccaccgttgaatgtggcaacaatcagcagtgtcttattcattgctttgtttgggacagcgctcgccaatctttgtttcttggggagtttacggtatatcacaccgacaacggcgggtttattgaatacttttgaaccgttagctgcgactatcggtactgttttattcttgaaaacgagtttcaacacctgggaagtcgtgggtgggattctcgtgatcagtacggtctttatcttgagtcttggtcaatctaagtcaaaataagttaacacggtgaaccgaattgtggtataattaacaacggagacgaagctcgtacattagtcaaaacaaattaatgattatgatgaagttgttaatcttgtcgaagccctaatgacaatttagctttaatccaccattcgctaaaagagcggttagcctgtctgcatagacaagttaaccgctctttttttgttagccgattaatttggtggccgcttttagcggttcaacgccaaaatcgttggcttctttaatcagaatcttggcacaagcgatactatcagccagtgcattgtggtgattgttgagtggaatcgctaggttatcacacaaggtgtttaacttatgattctcaaattgcggatacaaccgccgactcgttttgagagtatccaacgctaaataatggggttctggaatgtcgtagtgttggagtgtacttttcaacacaccaatatcaaaattcgcgttgtgggcgaccactaacttgtttggcgtgaaaaatggtgcgatgtgcggccagacttgattgaacttgggcgcttgagccacatcggcttcatgaatgccatgaatttgcgtattgcgactgctaaaataagtttcaggtttaattaacgtataaaaattatcaacgatttgatcgttgcgcacaacaacaagggcaagtgagcaagcactatgctgttgaccgttggcggtttcaaaatccattgcgacaaaattcattattttgaacctcgctttttataaagtttgcttattctaagcgaataaatcttgcgtgtcaagttcgacggggcagtggtcggaaccaaaaatttccgtgtgaatcttggcatcgactaatttaggttggagatcattggaagtaatgaaataatcaatgcgccagccggcattattgtcgcgggcgtggaatcgataactccaccaagaataaatatcgggttgatcaggatagaaataacggaaggtatcggtgaagccgcgatttaagagggttgtcatttgccctcgttcttcatctgaaaagccggcgttatgatgattggtcttatcatttttcagatcaattggttcatgggcaacgtttaaatcaccgcagaaaatgacgggtttttgagtcgataaattagcgatataagtttgaaaggcattctcccaacgcatgcgatagtctaatcgtttcaacttatcctgtgaattgggtgtgtagcaagtgattaaataaaaagtagggtattcaagtgtaatcacgcgtccttcttgatcgtgttcaggttggccgataccataagttgcagtgagcggtttatgcttagtgaagatggcagtaccggaatagccctttttttcagcgtaattaaagtattgatgataacctggtaaatctaattcaacttggccggcttgcatcttagtttcttgcagacagaaaaaatcggcatctagttgattaaaagtgatcataaagtctttttttaaaacggcgcgtaagccattaacgttccaagaaataaatttcattgtcgattcctcatttctaaattccattttaacggtctagtcaataatacgcaaaaaaagtgttggctgttcaattcaagccgtctttgttaaactaggagtagattattttttgaggggaacgacaattgtgacaagtcaagttgaagcatttttacaagcaaaccaagcaatcgagattcatcaagcagaaccattgagcttatacacctttaccaaaacaggtggaccggcagatttactcgcactccccaaatctgttgcagaagtgcggcaattagtggccagtgccaatgaactgacattacccattacaattatcggtaatgctagtaatctaattgttcgtgacggtggcattgaaggtttagtcatcatcttaacggcgatgaatcagattaaagttgaaggtaacttggtgaccgcgcaagctggagcagggattattcaaacctctgaagcagcttatagcggtagtttgaccggcttagaatttgctgccggcattcctggtagtgttggcggtgcggtctttatgaacgccggcgcatatggtggcgaaattagtgatgtactgacccgcgttgatgttttaatgcgcgataatcaagtacagacgttaacggccgctgacttagacttcagttaccggcatagtttaattcaagataacggcagtattgtgttggttgcctattttgaaatggcaacgggtgcggcaccagcaattcgcgcccggatggatgaggtcaacgctttgcgggctgccaaacagccgctagaatatccctcatgtgggagtgtctttaaacgaccagtcggtcattttgttggaccgttgattcaaaaagcgggcttgcaagggcatcaaattgggggcgcacaagtttctaaaaaacatgccgggttcatcgtgaatattgatcacgcaacggcaacggattatttgacgttgatcgaatacattcaaaaaacgatctgggcgaagtttaatgtgcgcttagaaccagaagtccggattattgggcaacataagcaaggttaaatcaatgatgaaaagctatggtaaaagatgattttatcagggctttttttatcaggatgagcgtgttaaaaagaaagggtgttgggatggcaattattgaagctgttattttgctaattacgttggtgattattgccaatatcatcgggcattatttgccaaatttaccggttagtttaattgagatcgggttgggattaatggtggcgttagtctttgccgtcaagattccactaaaaacagattggttcatgttggtgtttgttgcaccattattgtttaacgatggccgtcgttttcctaagaaggaactatgggcgttgcgcggaccaattattgggaatgcgattttcctcgtctttgcaacgacgttaattggcggcttggccattcattggttagtcccggcgttaccgctggctgcaagttttgcgttagcggcaatcttgtcgccaacggatccggtggcggtacaatcgatttcagaacaggccgatttaccgccccgggttttgcacttagtgagtggtgaaagtttaattaacgatgccagtggcttgattagctttaaatatgggattgctgccgctgttaccggctatttctcatggcaacaagccgcgggcgattttctgtatattagtattgttggcacactagcggggatgattatcatgttaatcattcattttattcgcctatttatgctacaacaaggctttgaagatgtgatgttccatacgattttacagttggtgacaccgtttatcatctatctaattgttgaagatctattccacgcatccggtgtgattgcggtggtggtagctgggatcatcagtcattcatcacggaatatcttcctcgattttttaccggagttgaagttagtgaccgaacaaacttggtcaatcagtgtttacttattaaacgggattgtctttttaattttagggattgaattacctgtcgctatgcataataccgtgcataatccgctgattaatacgagtgaagaaattctcctcgtcttagcggtttggttgattctggtgattgtgcggggactctggacactagcttacttgctctacaccaaccagacgaatcccaaaacattccgcgaaaacattaaaattgcggtgctctctggactttctggggttcgtggagcgattacgatggccggggtattatcggtgccaactgttttagcggatggttcaccgtttcctcaacgcggcttaatgctctttattgcggccggcgtgattattgtcagtctggtgatggccgttgtcttaattcctaagctgacaaaagtcaaagcaccaatcgagatgcgagggatgcaacgagatcttgaagccgaagcagccgcagaagatgaagcagctgctgatttattggatgaaacaaacgctaagatttacatgtacaaagtagcagcgagcatggtcgaatcccaacggcatattgataataaccgggctgctttagatttattggcagagtatcagttgatgatccgccggttggagagtcaacaaagcgaagcaagcacaagtgacgaactaccaccgttaattgctgaagagttgattttgcgacaagtggcatttgacggagaacgtcagaagttagagttgttatgggctgaaaaggccattagtgctaaaagctatcggcatggtaaacgtaagttacggcaaaaacaagtaatgttatcggttattgggacgagttttaattggcatcatgtgcaactacaagtctatcgtgcttggtcaatcagcaaacgctttttgacgcatctctggccgcggcataccaaatcaccaagtgaaaccgagtggcaattgactgaacgtgaaatggctaaggcgggaattaaacaattgtcgtatttcctaaaacagcctgaaaatcgccaacgtcattataatcgtcaggttatttatcaaattattgtgcggtatcggaatcagattgaaaacatgaaaaatggggggcggagtaagaccgctatctatgaacgtcaattacaaaaattaagaatcaaagcgctcacgagtgaacgagtggcgattcaagagttattggaacaacataaaatttcatggcaacttgcagatgaattacgcaaaaacattaactattccgaaaatgcactgattttagcacgaacggatactgaatagattcaaaaaagccccacgcactcattttaaattgagtgcgtggggctttttttgatggttagaataagtggcggcggcggtagtatttgtagctgtaataaccaccaattgcaaagccggcgctgattagtgaaatcgtcaaaccccaatagaaataaggtggccagtatttaagggtaacggtatggtgaccttttttcagcgggatggcgatgaagttcttcaagccgcgtttgattttaaccggatggccgtcaaccgttgcatgccaaccagcagcataggggacggttgtcatgaggacttggttttgttgaggaatggtgatcgttcctttgatggttgtgtttgagaaagtattcagtttcaatgcatgtgcacgaagttgctgcgttaggtgcgtcaatgcttgataattcaaactatataaattaatattttggagccaaatttcctttttagagaagctaaggtcaacggtttgttgttggccgattgcgttacttgtcaggtttaagacgacagtatcgcggaaagtatcgtattgttgtagcgtgtgaccgtttaatgagacctgaaccgcatttttttcgaggtttgagcctaatgtgaggtaataggggtcactcgttgtgggtgtgaaggtatagatgacgtgagctggattcttcggatcaacccggaggaaagtttcgttgagttttggtttttgtttagcattcttgtaagtgacagtattgaaaaattgaagtgtgaagagtggctgttctgtcgctgaattgactaagtctgccgcaatctggttctgttcaaggatgggataattggcaaccacatgatgtttaagcactttttcagaggccgcaaagcctaaatcaagtgcgttggggttttgataaattgcaatttgatctttttttttgagtaagttataacgtgctaagtccggcttattcgtactgagtggaattgttgcttgcccactagtattgttaaggtagtagcgataacctaataacgcatcggtgaacagggtctgattagtatcggcaacggctccatcgccagctggttcgccaatgctgcccatgaatttcggatagctcagttcgagcatcgaattaaaatgagatccgccgaaataatcagcttgcatcgggtcattttttgtccgcataaaggttttgccaattcgttgaaacgcggttttatttggaattgcgctaatggctgattgtaaatgagctgtataatctgcgtaatctttttgtgagacatagctaatttgattaagactcattgtcgcgttggtgaccatctcaccaccgacgcatagaactaagagcaaaggataatagcgcttgagcggctttttcaggagtaaaagcaagcatgtcatcagtaagaaagcgatgcttaagttaatctgattaggacttagcgcggtgaagctcttgagatgtttggcagtataaccaaaagccgccatcaacattaaaaacggcaacaagagttgataccaactaaatcgggggtgctggtggagccgttgaaccgcgagcacgattagccaaaagctaaccacatatgaaaagcggtaaggataccaaactggaaattgcatgccgtgccataataaatcaaggggctcataacacattgaaacacctaagaaaatggtgactaataaggcaactaaccgttcttgccaggcaatcttgcgtgttccaaaatacaagatggcacaaatcaatacgagactgccgacgaatatattcggttcgccttttggcatttggtcgaagttaaaattgccaatcacaagtttagaaagcatcttaagcggattatattcgaacttccaatgaatcttttgaatggtgtactgccctttgctctgcgtcaattggaaaaaagttggcaataggagccaggctgagagtaaaccggccaagagtgagccactgatgaagcgggcagcgcgttgccatagatggcgccaagtttgccaataatgagcacaagcccacgcaaaataagcaatgacaaacaggcaaaccatatagcccatataatagttactcattaagagtgcggcaagactcaatggataaagccaaaagtgacggcctgtaaagagccggtcgatgcctaagacaactagtggaaaccagacgagtgcatccaaccacataacgttaaactggttggcaattgcaaacccggataaggcgtagacaacactaagtgtcggtaaccaccagctatggagtagtttgttagattttaagtagtacgcaaagctaagaccactggcgcctgttttgaaaaggacaagcagccaaacaccaaaactcaaccaagttcctggtgtcaataggacgattagattgaatggactcatcaaatagtaagcccagaccccaagcatgtcgccccctaagcccttagcaaaggaataaaaaaaagtttcgggatggtgcaatagcgtacttctgaaaaaagcgtaaaaatcgatgtattgttggcctagatcaacagtcaggattgtttgccctccaaaagggaacacttgtcgaagtagtccgtagataaataaaatgccaaatggtagtaagaaactaaggcctaatgtataatgacgacgtgcaaaagcgtaaaatcgactcacggtaatcctccaattaataaaaaaatctaaaaattaggttgctagtccgtttttaactgagaaaagctgtaaaatataaccagttaatgactatgcttaagcataccataatctcgtttgaatttagagatttggcatagcttgtttaagataattttgctaaacttaaacaatacagcacaaaatcgctcaaaaggtcgcttggcgactttttgaagcatagagcggcgccatcttttactagagcggcgctaaataaggagtatctgaccgtctgtgaaaatcattaagagaaaaaacaaacaaaatcgtgaaaaatcactgattccattccgcttaaatttcctattattcgttgtcttcgcgttatttgccgcgttgattatgcaattgggacgcctgcaagtgatggagggcgctaattttcaagcgatggtcaacagtactgataagaaaatcgttacaggtaacgtgcctcgagggatgattctggattcaaagggccgtgtcttagttgggaatactgctaaaccggcgattacttatacgaagaatatgaatgtcttggcagacaaaatgtatgcagaggccaataagttaacccaatatttaacggtcccgacggataagttaactgaacgtgatcagattgattactacctcagtaaccccaagaatcttaaaaaatggaacgcaaaactgcctaaatctgcgaaggttgccagtgatggttctgagttgccagaaaagaaggtttatcaatcaacaatcgaattggttaaaaagtcgtttaaagggttaaacgagcaacaaaaacaagccgctgcgattttcaaaattatgagtggggcttatcaattatcgacagtttatattaaaaatacggatgtgactgataaggaaattgctgaaatcagtgaacatctaacgagtttgccagggattaatgtcagcaccgattgggaacgggcttatcctaatggcgattcaatgcgcagtattattgggcatgtttcaactgaagagcaagggttaccagaagatggcgtcaactccttgctagcacagggctattcgcgtaatgatcgcgttgggaccagttatttagaaaagcaatacgaaagtgtcttgcatggttctaagtcgcaatcacaagttgaagttggtgcgaataatcagattctctcaagtaatgtcttatttaaagggcaaaaagggagtaatttaaatttaacaattgaccaagcttatcaaacgcaagtggaagcggctttgaagaaaatctatgatcaggcaaaagcagcgggagccactcagtattctgatggtgcctatgccgtggcgatgaatccgaaaacaggtgctattttagcaatggctggcgaatccaacgatcgtaagtcagttgaaattgccgatgatgcgctcggggtgattaatcacaccttcgtcatggggtctgctattaaaggggcgaccgttatggggggcttaatggatggtgtgattacgccaaccaataataccttaccggatacaccaatctatttaagaggaacgccggttaagaaatctgtttacccagttgggacgtttggatcattgaacgctgaatcagcgttggaagtttcttctaatatttacatgatgcaattagcgatgttagaagggcatgccaaatatgtacccaattcttcgttaacgatggattcagatatctttacgaagatgcgtggctacttcagtcaatttggcttaggacaaaagactgggattgatttgccaggtgaagccaccgggatcgaagggccaaccgtcaatgaatatggcgagccagccaatggttcattacttgatttatcttatggtaactacgatgcctacaccttaattcaattggcacaatacatttcaaccatcgcaaacggtggtcaacgaatgaaaccataccttgtggattcgattcaacaaactggtaacgatgggtcagctggccaagttggtaccaagaccacgccgacagtgcttagcacagttgatgcgcccgaaagttactttaatgtcgttaaaaaagggatgtacaacgttgtcaatgggaccaacgcttgggggacagcacacaccttgaaagatattaaaccaacgcttggcgctaaaaccgggacggcacaatcatttgcccgtgaagatccaaacgattcgacaagtaagcaagtcgaaaccgttacttctagtttggttggctttgctccatacgataatccgcaagtggcaatcgccattgtgttcccgaacttaaactctgataaagggcactacaatacgttactagcccgtgaaatgattacgagtttctataaattaaataacattactgaatgaaatattccaaaataaccttttcagataccataaaaaatggtatgatactaagagtctaagaattaaacagttttttagaaatttacttacagcttggaggctatatcaatgcgtgttcacattacaatggaatgtacagaatgtcacgaacgtagttacttatcaaacaaaaataaacgtaacaatccagatcgcttggaattaaagaaatattgcccacgcgaacgcaaagtaactttacaccgcgaaactaaataatagtgacgcacatcaaaagtcggggcgcttcgcgctcgggcttttttttgttaaggaggcttttgaatgcggactaaaaagcaaattcggcaacaacaaattgcggcattacaaacgcttgcgcagacgcctgcgcttaaacatgcccaagaagcacaacttttggaattgttaatggcaaccgaggtgtttcaaaaggcaacaatcatcggtgtcacgttgagtcagccaattgaaatggcgacccagccggtaattgatgccattcgtttggccggtaaagaagttgtagtgcccaagacattgccagagcgacaaatggctttttacccgttaacggcaaccactgaattaacaacgagttcctatggtgctttagaaccagtggttacagctggtagccaggtgttaatccctgatttaatgattgtgccgggactagcatttagtccagaaggttggcgggttggttttggtggcggttattatgatcgttatcttgccaaatatccaatgccaactgttgcactagcgcttaaaccacaacaacgaagtgctgattgggccattgatgaattcgatatccaactcgatcaggttcttcaggtctaaaggagaaaagatgactaattttaaagaacgttggcaagacgcaccgattgtggtgtatgccttgatgttactaacgattttgatgtttgcaatgatgtttttgaatccggttgtatggttgaacggctttacatcggttaacatgctaatgaatggccggattattgggtttatgatggcatctgtcaatcatggccggtttatgaatctcttcgtagatttggttattttgttttttgttggtggacaacttgaacgattattaggacactggcgcctattagctatctatatactgagcagtttggcgagtttgtttacaacgggcgctttttttggtctcgatacaccaaccgtgactgctggaacagctatcttagggctattcggtggcttcttgatgttaggtgatgcctttaaagaagaatccgtgctaggacaagtggcacgccagtattggctgtttttatttttaacaatcggattacaatttattgtcgatcacaatgcattgtacgcaatggtaggtggggtacttggcggctttttaagtagtatggcgttgggtgcacctaaagtgggtaagattaacccgctgaaccgtgtggtgagtgggttaatttatgttgcaacgatgattttatttggttttctgggtatgaatcattaatcaatttatgtataatgttaaaggtgaagttgatgagaactctatatgatgtacaacaacttttaaaacaatttggcgtttacgtccatcttggtaaacgactttgggatatcgagctcaccagtatcgaattacggcacgtttatgatgcggggttaatcgatggcaaagtgtatcgtgatgctaagatggttttagtgcgtgaacatcggttggagaaaaatgaagcgtttaatcacaatttattggaggagaagtttaaatgacagacaagaagttaatcggcgttgatttaggcgggacaactgctaaatttgcaattatgacaatggatggcgaaatccaacaacgctggagtatcgatacggatattttagatgaaggtagccacattacaccggatatcattgaatcgattaatcatcatttagatttatataacatgacacctgctgatttcatcgggattggtatgggcacacctggtagtgttaacagtaaagaagggaccgttattggtgcttacaacttaaactggaagacaacccaatacttacgtcgcgatatcgaagctggcacacacatgaagcttgcaattgataatgatgccaacgttgctgctttaggtgaacgttggaagggtgctggtgaaaaccaacccgatgttgcttttgtcacacttggcactggagttggcggcgggatcgttgctgatggccatttattacacggtgttgctggttctgcaggtgaattaggccacgtaacagttgaaccacatggttatgaatgtacgtgtggcaaacaaggttgtttagaaacttatgcttcagcaaccggtgttgtgcgcgttgcacgtgacatggctgaagaatacgctggtaattcaaaattaaagacaatgttggatgatggtgaagaaatcagctctaaattagtttttgacatggctaaagaatcagatgcattggctgttaaggttgttgatcgtgtttcttactaccttggtttagcattagctaacgttgggaacatgttgaatcccgcttacatcgttatcggtggtggtgtttcagctgctggggaatttttacgtaaacaagttgaagcttactttgaagaatttacattcccaaatgttaaaaatacgactaagattcgtttagcaaacttaggaaacgtagccggtgttatcggggctgcttcacttgcacttcaatttgatcaacaataatttgttataagggagtcttatcgatgcttgtattagggacaattaatgtatgggtagtaattaatattattctgatcgccattttactttggttcttgggcgattgggcatattatcaaattcaacgcaaacgcttaggcggcgaattaacggaagcggcgtttgaagaaacaatgcgcaaggcccaaattgtcgacttacgggataaaaaagattttgatgcaggccacattttaggcgcccgcaacttaccttatccaatgttgaaacaaaatatgggtgaactacggatggacttaccagtctacttatatgatgcaggcattacgctcagtatccgagcagcactgaagttaagaaaagctggtttcaccgacattaaatggttgaaaaagggttatgctggttggaccggcaaaacaaagcgtaaaaagaaattaaattaaaccaaaaaagcccaagagttactagcgaaaaaaactagtcaactgttgggctttttatagagtgcgcaggcagatggtcatgttctgaggattagcaaaattggccaaacaaatggcgaagctgtttgtttggctaattaggctaaacgcaggaacatggtttgaaaagcatgttttaaaaagcacggttccacaaaaaaagtccgtcgccaatcaggcaacggacacagtcttttcaaagcgcttagccttggtgagctgaatggctcttacggttagcacgtcgacgactttcttcaatttgattttctttttcttcgattggatcaacgacggtcttcttaaatgccaagagtgaaccggcaatcgcgccgactgttgaaacggttccgattacgaaaccttttagaaatttatgtttcataggtaaagcctcctcaagtctcaattcattcaagtacaactttattatcgcgtatttaagcgcgaatagctagtaaaatacgttaattaatgtggtgaaaatatggaaaaagaaaagctaatcgtcattgtcggtccgacaggcgttggtaaaacagcgttaagcctacaactcgcacaacagttgcagggtgagattgtttccggggatgcgatgcaggtttatcgccagttagacatcggtacggccaaagtcacaccaaaagagcaggcgcttgtgccgcaccacttaattgatgtggcggatatcgatcaacgcttcactgcctttgactttcaacagcaaggacaacaactcgtcactgaaatcgtcggccgtcaacacatgcccttggttgttggtggaacgggactttatttgcaggcgttactgtacgatatgaccctgggcagtgcgcaagatgcggaacagaattttacgattcgtcaaaaatggcaaacttttttggatcagcattctgaagaagctttgtggcagacgcttaatcaaattgatccgcaagcagccgctaaaattccgagtgcgaatccacggcgtgtgattcgcgcattagaggtttatgaaacaacgggaactttgttttcacaacaaaagccaaaagaattacgttatgatacgtttattattggattgaattgtgaccgtgcattattatacgagcgaatcaaccagcgggtggatcaaatgatcgatgctggacttttagaagaagcgcggttggcttatgtacatcgtgaaacgagtccgcaagccgtacgagggattgggtataaagagttctttccatactttgatggtgactgttcattagacatggcaattgatcaagtaaaacaaaattcacggcactacgcgaaacggcaattgacgtggtttagaaaccagattccggtcaattggtataatctggttgaacaacctgaagccgatttggcccggattcaaaccgatttacaacaatggttacagcaataatagaaatggagtggttaaaaaatggattggcaagcaaacttagcaccagaattacaagctaaaatcgcggcagttgatacgcaaatcgcaccgcgtttacaagcactggatgaacaaatcatcaataatcaagcaaaggtgctcgaagcgtttcaagcagaaaatatttctgaatcgcatttaaacgggacaaccggttacggcaacgatgatcaaggacgcgataagttagaggccgtctatagtcatgttttcaaaactgaagatgcgcttgtgcggccgcaattggtttccggcacacacgcgattggaacggccttattggggatgttgcgacctggcgatgatcttttgtatcttacgggcgaaccatatgatacgttgcaagaagtcatcgggatggccggtaacgggattggttcactaaaagaattccaaattggattcgatttcgtgccattattagctgacggggccgtggattttgaaatggcccggaccaaaattacagctaagacaaaagtggtcgctatccaacgttcacgtggctatgctgatcgcgatagtttcacggttgataaaatcaaggaaatgattgcctttgtcaaaaacattaatcctgaattgattgtctttgtcgataatgcttacggtgaattctctgaaacaacggaaccaacagaattcggggccgacgtaatggccggttctttaatcaaaaatgctggtggtgggattgcgcaaacgggtggttacatcgtcgggactgaaaaattaatcgaaatgattggttatcgcctgactgtgccaggtgttggtgccagtgaaggcgccacacaaggcaatctacaattgatgtttgaaggtttcttcttagcaccaagtgtgactggtaatgcgattaaaggggctgtttttgaagcagcactcttggaacaaatgggcttgagtgtctcgcctaaatgggatgcccctagaacagatttgattcaaacggtgaacttcggtaatccggatgatatggttaagttcgctggttgtgttcaagcacaatcaccaatcgattcatttgtgacccccattccaagtgattttgccggttacgaagatcaaatcgtaatggctgccgggacctttatccaaggtgccagcattgaattttcagcagacggcccattgcgcgccccatacacactttacttacaaggtgggttaacttacgcgcacgttaaactcgcgattagtcgggcagtccaaacaaccttctttgaaaaataaatgccaagcggtcaatcaaattcgcgtttgattgaccgctttttttgtgcgttaagcgtggtatgataaggatgcaacgaatcgtagcggtcggttttaagtgatgctttggattgttgctagtataaatgggtcattctcgctacggtaagtcttggaggtggttagatgttaattggtcaacaattaaaacaatttcgtttggatgcgggctactctcaacagacactcgcagagcagattaatgtgtcacgacaagtcatttctaaatgggagacggataaaagtgcaccagacttgaatacattggttgttcttgccaaattgtataatgtaagtttgaatactttgctcggggttgaaacggttactaaaccaaattcattcatcggccggttgcggcaacactggcatttggcagaaagcgaaagtacaaagccgttgtctaatttggggcggattatgcaacaacccgaacaacactatgtggatttagcacaacagttcagtgccgctttgacggatgtaactgttactagcgatggccaaacaatgccagcgaattggcggcaagcacggagtccttatttaattgtattagaaccgcgccaaatttgtcttttggaggagtagcgaagtggctaaacgcggcggactgtaaatccgctccttcgggttcggtggttcgaatccactctcctccatattttttagggatatagtttaaaggtagaactacggtctccaaaaccgtcagtgtgggttcaattcctactatccctgtttatattatagcttgcatattatgtgtgaatgtagtataattattcatgttaatgatggcggtattggtgaagtggttaacacatcggtttgtggatccgacatacgtgggttcgattcccacataccgcctttattcttgggctatggccaagcggtaaggcaacaggttttgatcctgtcatgcgctggttcgaatccagctagcccaatttactttttaagggacaggatttgttcttttatggcggtatagccaagtggtaaggcagaggtctgcaaaacctttatcaccggttcaaatccggttaccgcctttgcgtttaggcgctaaccttaattggtcaaaatgccggtgtggcggaattggcagacgcgcgggattcaaaatcccgtttcctcacggaagtatcggttcgaccccgatcaccggtataattgaacattatacagttttaaaaagccttagagatagggctttttttgttgcgttaataccatggttcttttgaatactaatagttaattgataaataaaaaagcagcctgcgggctgctttttttacatggcattacttattttaggaaggttaccgctggggttgcggtcgttagttgccacgtaatgatgccagagaagtagtctgtttcggctaattcgattgatgaatttgcattcaaatgcggttcaccagtaattggccaaataccactcgtcatctgaactgtacgacctaaatcagttagttgattttgatcagttaatgttgcggtgttgagatttacaggtaagccggttaagcgaagtgatgttccagtaaggaggtcttttccggaggtgaggggggtctttgcgcttgcaagtgccagttctgattcagtcgtgtgtcgctaatctctaaattaccggtggctgtgggcttaaggggggtggccgcattgcctgtgtaaatttgttcgattgggacgtcagtaaatgcaaaagttggcacttgtttaagggctaattttccaataggtgcagtgacttgcagtcgcgcttgattcgttggaattgtaagctcgttaccgtctttattagctgtcaaagtcaattttactgaaaaaggttgcttgttttcggtcgctttttttgcgagttcaatgaatgaactgtttttgggaatcaggagctgttttgtggtgttgagttcagctaaattcgtaatctgaccactggcattcaatgcttgatcggcagtgaaatcgtgtgcgatattttgggcatcatagtagacccatttgtaacgccattcgtagtcagtttgatactgctcaactaacggtgtcagccctgcaaccgaccaggtgaagccactttgccgcgtagcttcttcactagttgtcagggcttttaacccaccgacataaacagttgcattatcctgtaagccattggtctgaccagttaacgtcaatggtaaaccggcctgttcagtactttcgttgatgccagcgatttcgttggttttaaaccgaacgacacggccggttgttggtaaataagtcacattaggactcgcccaagacacaggactagttgaattaacaggcgttaagttagcttgtactcggtaatctgcattggcaaagacaaccgaagtgtttggttgaatatcaatggcagtcgccggagtttctttttcaaccacagtaatcatcgcaagttctgaatagtaggtactgccaaaatatgtcacggccatttgggagtaatgcacaccaacgggtaaaccactagccgtgtaagttgtgtcgtggagaccattgattgttgtgttacttttgaccgttgtgctgggctcttttaaccaggtattatctgatttgagcgaccagtgattgacggtaattctagcagaggatggccaaataatggggccacctgttgtttgtacattcagttgcgcactatcacctaggataatgtattgttgagcttgtggttggccgttgaatcctgcgcgccaagggactaagaaccagaaaccatcccgattcggattgttgacgccatcagcagtactggggggagtgactgcttgaggtatctctgcttttggggaagcattttcaatcgaagaggtagggggcttgattcctgagtgacttgaactggattcggacgggctagcttgaacggcatgttgtgttgtctggctaccaatgattagtagcagtgtgatgagaacaagtaaaatgtggacgggtgattgaaaacggctagtcattggtagctccttccttagtcaaattggattggtggtgattgaattttagcaagccagctaaaattaggcacaagacaccaataatttgccaaagagtagtggtggacaagccggtttggggtaacatgtcatgacttgtgatatgaaaaccagtttttttggggatcgacgacatgtgttttggaggatcaactggttttgtaggtttgagaccttctggattcacaactctaacttgtaggtgactggttgttgcggtagcttgagtggctgagagtcctaagcaaaatcctaagcataataggctgatgattagctgcctagtcatatttagcatctcagtgcctccttttacgccggaatgtataaaatactaaggcggtaatgacaccgactaatataataataattagccagagtacataattaggttgagctttattggtcatgtttttatcaatctgtttctcttctttacgactaatcgtaaagtgccgttgtaagtggaactttttttcacctgaacttaatgtcaatgggcgcgtaccgattggcattgcataatcgagtgttgacgacggcgccatctcataattcttaacggattgttgaagaagaatttgcgtccgatttcgtttgtagagtttagcatctaatttaatattcccaaacatataggggctcttgttatgaatggaggtgattaactttggtaggccgccatgatttgtcattttaacagtcgtcaacgatagtttggggaatctaggttgattgaaatcctctgatagagagaccggattgctcattgcgaaccgattttgaaagctcatattctttgctttcggattatcatccgttaaacgctttgtatagaggctaccaagaattgtaccggagaacccttttgggggaatttttagatgaaacgtaatcgttcgttcttcttttggtgtgagttgataagtttgacgccgttgattcttagccactaaatcaggtaataacggcttatccgaccagttgcggggttgattggataaggtataattgattttacctgaaggcgatgttgttgccgcgaccagttcagttgaaaagcgatgggttttatccggacttagattacttacagtgaccgcaacaggtacggtctggttgggggaaaccgtcagcgagaagtaatcgagattgtctggattttgattcactgcaaaaacaggtgttgtggcaaattgtgcgccatctgcagcgtgaacgggtactaaagagaagtagagtaaactaagaatcccgacaccggtcgttaaacctagtttgctcaatattgtacacatctgcttgatagtaatcattacataatccttccaatcaatcgtttgtccggattaaaatcaatctattaaagtgctgcggcgactggcccagttgatgatagatgccaagtcattacacctgtataagtttgagcagattctaattcagcacttggatttggtgcaacggtcaatgcttggttattgatcacataactatcgttaccatggacactaccatcactagttgctaattgcaccgttgaactatcagccggtattgaggcatcaattgggctcgatgaccaaagtgaactagtcgcagctaacgcgagttggaaaccttcaagagttccttgattgacactgttggcgagaggttctaatttaacgcccaatttccaatcatgttttccagcacgattatcagtaattgtcaggttaccagtattggtgatgttccctgtaaatccagcatagatttgactggcagaaatttcttcatcggcaagtgaaaagtgggggacagatttgagcaataattttccactttcaggatttgtggtggaggttgatttgaccgtcatcgaaacttcaccttgcattggactaccttcagcctcgttgtcgacagcagccacggggctgacagtaatcagtacgctggagagtaatagggataagcctattactgaaacgttttttgtcattggaagagactcctttcgaatgtaaagcatattttttacaagttggccaactcgtctttatctgatgctaagaatagcggtaaatgatttgaatgtctaatggttagaatacaatccaattgcgcgatagttgatatgatagcgtttgcgaataaaagcataactaagaagtataatgttctcaagcgatataagttgaacgcataaaaaaaacgccaccgatttggtgacgttaatgacgtgattgacattgataaacatgatcgattaggaatttggctgcagccgagggtggtcgttcatttgaccagataagactagtgttacttgttaattcgggcattagtgggatgaaggcgagatcggactgcgggacttcagagtgactgtttaagtacaacgcataaccgattccggctgaaacaagtcgcgctgcattttgatggaaattatacgtggcgacttgattgagggtggtgagcggtttttttaaccattgtgcgaactgggtgttaatgacattttgttgcgcagtgattaaaggcagttgtgtcaaatcatccggtgtcacgacccgatgtgttgcaagcagactattttgtggagcgaggattcccaggttgtatcaccggggagttcgacagcattataattctgagtatcggcgggattcaacataatcccgaaatcaaaaagccctgattgtaacttattgtgcaagtcttcatcggttgtgctaaaaaggtcaatctgaatatccggttgccgactggttaaccgattaatcgcttcggcaatcgattgggttaactcgagttcaccaataccaatcagaatgcgaccactaacggattgcccttcatgtaagttaacgactaacttgtccatgaggtctaaaatatgttggacctgctgggtaaaatattcgccaggaggcgtgagttgaatgttgcgactaccacgtttggataacgtaatagagagttcgtcttctaattctttaagctgcttggaaatggttggctgagaaacatgtagttttttagcggcacgactgatgtttcgctcttggacaaccattgagaagtaacataagacacgaagttccatatcgattctcccaacattaacttaattgttagactaatataaccactaacttaatgagttgtcaaagtgaaaattaagaatatcaatataaatcaaggataatttgtttgaaaatatcacaggcgaaatgcttgaaatttatgtcattaaacgtcataaaaggcttttggttagttgcttataaaaatattatggcatattttggctgataaaatattttgcaataaaaaacctctttgattaaatctcaaagaggtggaaatcatattgattgatttatataaatacgggcaacgtttgataattaaaagcgactagtgagttgctgtgccagtaataatctcagttgagcagtaaattgtctcataaattgattgacgccttcaagcctggagttaattgtataatcatcttgccgaagctggttaacggcgtctttcaaccaggataacgtcggtttctaaatcctgcataggtgaatcaatggcaatgtttgggatgttttgttttctgcatttttttgattaacttacgctaaattaattgacaccctttatgaatggtatggtaccataggtgtaattagaaaagcgaagggattcgggcgcatgcgacgttctaaatggataataatcatcattggtttaggagttttaattggcagtggatggtggcttttagggcatgcaacgacgcaaaaagcgcagcaagtcaagcaaacagaaaatgaacagcccactttttatttgcatggttatggcggttcggctcgttcgactgatagcatgatcaaagctgctcgcgaacaaaagaatgcgacacaggtcctcactgcaaccgttcgtaaggatggttcagttgatttacaggggcgttggttagctaaaacgacacgaccaatcgtgcaagttgttttcgaagataatcgcaatcctaactatcaacaagatggtgagtggtttaaaaacgtcttagtcgcggttaatcggcagcacagcttcaaacgattcaacgtggtggctcattcgatgggcaacttgacggccgtttattatttattgaaccatgcgattgataaacagttaccccgtatggcgaagatggtgaatattgcgggtcattttgatgggattatcgggatggatgatcagcctaatcaaaaccaggttaaaaaggatggccaaccacaaaaaatgaacgcgacttatcggcaactgatgggactgcgtaaccagctccctgctaaatcgattgcggtgttgaatatctatggggatttaggcgatgggacgcattctgacggacgtgttagtaatgcatcgtcacagtcgttgcggtatttggtgacgcctggtgcgaagacctatcaagaaaagaagtttactggtaaaaaagcgcagcatagtcaattacacgaaaatcatgcagtcaatcaaactgtcttagcgtttttatggtaaaacatacttaaaaagtggtggcgacaaaaattaattttgtcgccaccacttttttaatgttcaagacggtagtctcgcgctgcttgttcgagattcgaaatgagagcttgttgttttggtgagaagaactgggtcttacgataggctaacgagatgtaaaagattggttgtggttcatccaataaatcaagtaccactaagtcatcagcaggcgtaacactggtttcagttagaaaaccgatgccgacattttcgtgaaccatactttttaagacactaacgtcattggtgcggtaaataatttcgggtttgatttgattgacgtccgataagttcttgaagaccacgggatgcacgaatccttccgcgagcataataaatttctcgtgggctaaatcacgaaaggcgaccgctggtttctgggctaagggactatcaggtgcaactacaatcttaaaatggtgacgttcgatgactttagctgtgatggtatcggtttgaagtggcgtcgcagagccaagaagcgcgacatctagttcaccggcttctaatgaagccaacaattctttggaacccccatcagttgtcttaaaatgttgaatcgtgccgttagcggctagcttttgtgctaattttgagaagtagtaagtgccgataattggtggcaagccaaaacgcaaatcagtagcgttgagattgagcatgtcggcctttgttagttcaatctccgctaatattcgcgcggcatgttgataaagttgctcaccactaggggtaataatcaatgattggtgtgattgatcgcgctgaatgagtttggtcgcgaattcatcttcaaggcgtttgaccgcgtaagtgatcgtcggttgactgaccttgaattgatcagcgactgccgtaaaattttttaatttaattagcgcagcaaaataggccaaatctttaatcttcataaaaactcctgtttaatgcagtttagacgtttcatataaatctattttatcataaatgtaagttttgactatcaaatgttgaggcgtgtatagtgaccaacatgatataaaagaaaaggagatttttaatatgaaagcacaacaaattttaaatgatccatttttaaataagggtacagcattcactgctgaagaacgtgcacaatttggtttaacggggatgttaccacctcacgtgcaaaccattgatgaacaagttaaacaagcttatgcccaatatcaatcaaaagccaacatgcttgaacaacggattttcttaatgtcaatttttaatgaaaaccgtgtgttgttctttaaattattcagccaacatgttgctgaattcatgccagtggtttacgatccaacgatcgctgacacaatcgaaaactacagtgctttatatgtgaacccccaaaacgctgctttcttatcaatcgacgatcctgattcaatgaagacaaccttggcaaacgctgctgatggtcgcgaaattaaattaatcgttgtgactgatggcgaaggaatcttagggattggcgactggggcacacaaggtgtggatatctcagttggtaaattaatggtttatacggctgctgccgggattgatcctagtcaagtcttaccagttgttttagatgctgggacgaaccgtgaaagcttactcaatgatgagttatacttaggcaaccgtcatgaacgggttcgcggcgatcgttactacgatttcgtcaatcaattcgtgcaaacagctgaagacctattccctaatatgtatcttcactttgaagattttggccggagcaatgctgctaatatcttgaacaagtacaaagatcaaatcgtgacgttcaatgatgatatccaaggcacagggattatcacattagctgggattatgggcgctttaaatatctctggtggcaagatgaccgaccaagtttacatgagctttggtgctgggactgccggtgctgggattacccatcgcatcttcgaagaaatgttacaagaaggtttaactgaagaacaagcacgtagccgtttctacatggttgacaagcaagggctattgtttgatgatgatccagaattaacaccagaacaaaaaccatttgcgcgcaaacggagtgaattcgctaatgctgatgaattaacaactttagaagctgctgtcaaagcaatccacccaaccattttagtggggacttcaacccaacctgggacctttacagaatcaatcgtgaaggaaatggctgctcacacagaacgcccaattattttcccattgtcaaacccaacgaaattagctgaagcaactgctgcagacttaatcaagtggactgacggcaaagctttagtagcgactgggattcctgctgcacctgttgaatacaacggtgtcacatatgaaatcggtcaagcaaacaacgctttagtctatccagggcttggtttaggcacaatcgcttccactgcgaaagtcttaaatgacgaaatgattagcaaagcagctcactcattgggtggcattgttgatccaacagaacctggcgcagctgtcttgcctcctgtgacaaaactagatatcttctcacaaacggttgcgaacgctgttgctcaaagcgctgttgatcagggtttgaataaagaaccaattgctgacgtgcaaaaagccgtcgcagacatgaaatgggaaccagaatacaaagcactataatttaaatataaatcggtaggagcgtgaaagagttggcagcatttctaacatcattatcaagcgttgtcgaaatcgtcttagtcattgcattggggttttggctacggagttcaaaaaaattcgatgataattttaaaggcacaatttcatttttaatcatgaatgtcgctttaccattatcaattttcgtctcagtattagataacttaacccgtgaaaagttggtcggtttatctggcggcttgatctacgtcttaattagtttcgccctcggttatctcgtggcatggttactaaccaaggctttccggattcggccaggtcgtcgagggacatttatcaatatgttcgtcaatgctaataccatcttcattgggttaccattgaacttggcactattcggtgacaagagtttaccttacttcttgatctactatgtggccaatacggtttcaacatgggcaatcggggtcttcttcatctcaaatgatgatccaaccaaagaaaaaggcgctgctaaaggcaaatttaactggcgtaaattattaccttcaccattaatcggtttcttagccgcattaatttatcttttaactggtttaccattaccagaacttgttgataagacattctcaatggtcggtggcatcgtaacaccaatgtcattgatctacattgggattatcttagctgatgctggtttgaaatcaatccatttcgaccgcgatacagtccttgcgttattaggccgtttcgttgtggcaccagccatcatgattgccatcatgctattcttcaagaacacaacttcaattccatcaatcgaacaaagcacattgattattcaagctgcaacacctggtttggctgtcttaccaatcttagttggtcaatcacatggtgacgttgaatatgcaacgaacgttgtcacaacaagtaccgtcttattcgtggtcgttgtcccaatcttgatgcaaattgttcaatatatctaaagcttaaatgtgtcgttcagctaacactcccctaaattttacccccagcgcgccgtctcaattaattgagacggcgctttttttgtgcaaagaaacacaaagaatgttgtcaaaggcggtaaagtgcattacaatgaaaacggattcaataatgtgaaggggacgatagcatgacagagaaaatctacactaacttagcacctgaaccattgggaccatacagccaagcgattgcaacggatcaactggtctttatgtcagggcaactcggattaaaagatggccaattggcaccggacttagcgagtcaaacaaaacaagcaatcacgaatatgcaacacgtgttagcggcagcaggattatccctagaaaacgttgtgaaaaccaattgttttttaactgatttggatgactttaacgaattcaatgaagtatatgcgcgattcttcggtgatatcgcaccggctagaagtgccgttcaagttggtaaactaccagctggcgcaattgttgagatagaagcagttgcaattcgttaatgccgtaattgactgaataaacaaccatttgaaaaaagcctccagaggaaattaaatgcatttcatttaatcatctctgggggcttttttgcatgcctgaaatttaatgtttaaagggatgttcatgggtacaaatactgatatataggcattgttgtgaaaatattctaccaatgttaattataaaaagattaaaattagatgatgaaaattgcggataaaatgaagctccagcgcgaccattttgatgacatggaaccgaatacaaatatcggcattaaagaagtttacacatgttgcataatcatagatagggattatctctttaaaagatttaacagattcgttttaaaacaacttgtacacaatttaatagcttgtcagaatgaaaaaacattaagtccaattggtgattaattgattgaatctttgatatcccaattgataactagaccgtaccaaaggtgtagtgatgaatggaaaaatagaaaaatcatatggaggtagacgatggatagaagaaaattagcgctgggtgcaacaatgctgaccatgttattgacgtttatctgtatcaatagtggtcgtactcaagcagcgatacccgcccatattccaatcgatggcatctttaaaccctccattggggtagatagttccgttcaagcaggtggaattgtgcaagtgacaccagatagccagaacaagaaggaggcaatttggtcggaagagcagtataagattgatttgacacataattttacaagtttaatgtatgtcaatttaggggacaaaaaagcgcaatcggttgacgggatggcctttgcaatgatgaatgacccagacaaggttaagaattggcagcaagtgaccggtggcgcccttggtgtttggcggaatccattttcttgggtaaaagataactcagcaatcgccaagtcatttgccgttgaattcgatacgtaccataatggcaatgattttgacggtttgctacccaatgatggcccagatagaggccatgttgcttataattttccaggacaagatagtgcatatcagcgtttaccaagtcgcttgtacgcgctaaaccatctacaacttcaaaaaccgcaaaatggtgattatttatcaaatgggacatggcacccgtttcgcgttaagtgggatagtcttaagaaacaattgacttatcaattcgacgattatgcgcccgttacagtcgccattgatcctgcgacggtgtttggaacaaatcaggtttactggggggttaccggatcaaccggtgattattcagaattaaatcaagttgtcttttccgaaataccggggctcaatagtattgattctccagtaacaatgactgatttagaaaaaacgacgcccacggtcagcttaaccaataatcaggcgatgcagaccagccagttatatgtagggcgaacggttcattacagcattacacaaactaatttaccaacaaatacggaggatatcgatcaattagtggctaatattcaattagggttgacgacttataagccaggaacgttaaaggtggatggtgtttctcaacctgatagtcactggaaaaccggtaagcaattgcagcaagctgttggttcgctaacacaacataaaatgactgctcggattgagtttgatgcgacggttgatcaaatcgatgtgtcaaaggcacaaacagcttcggcgactgatcagtttatctacaatgccaagtcactaatggataagcaatttaaaatgccgtatacggtgacaaatgattttacccagattgtcattaataataacccacagcatcggattaccgcttatgagttggggaagatgaaggcaatgcaaaacgcacaggatgtggttcgagagcttgtcagaatcgggaatattgcccaacgctacagtgataaaaagcccatcagcaccgatcagattacgactaagacggatgcattagcggcaattaaaaaacttaaccttgggtaaaagtttgatcatttcatttattgcaaacgaaccagggatgtccgcagtgagttcggtaggtatttttatagttgattcagataccggttcattaacacgaccattcacatcgacggacggcaagcatcaattgctagccaatctggaatatttaaaaccggatggctcggggccgattgcgattacgaatacagcaactccaattgcagctggggataatcgcagcgatcccacgaccaccataacaaatcagtggacggataaaacggggcttgctttaaccaatattagtaatgggaattatcctggtgattatacaggtgaattaacttggacactgagtgatgtgccacattaggcttagttatgaaaactttaagggggtgaggcggcaatcaattagtgatcaatctcagcttaaacagagtggacgatttagggttaacttaatccaataaggattgagtattttaataaaaaaggatggattaaataatgaaaaaaacaaataaattaatgatgaccggtgcagtattagtaacattaggccacatcgtgatggcaccaagtgtacaggctgcgacaacatcgaatgaaacaactacggggaaaattgcactagaagcaggggacacaacaacgactaacccaccaattgtgccagggacagatggaaacggaaacggaccaactggcgcaacaggggatatcacgattgataatttaacaccacttgattttggtaaggtgaaactgactggtggcgcgcaaaacgttaagaatatcgttaaagatcctaacgtacaagtcaccgataaacggggaactggcgctggctggaatattaccgttaaaagttcagaatttaaagacacaacggattcaacgcatatcttaaaaggcgcacagattaattttccagttggtaaagtagtcgctagtgattcaacgaatactgctgcaccaacagccaaagcgattactgttcctgctgatgggttggataatgcgcaaatcttgatgagtgctgataaagataaaggggtgggaacatgggcagatgtgatgacaactgacggcattacactggatatcgctggtggcgcttatgctggcagctataatgctgatttgacctggacacttggggatacaccgctttaattagctggcagtagccgctaaatttgaaagaggcaagtgttaaatcgttactgcaacggactaaattttaatcgatgtgcaaagtgattaaagagagggacttcaaaaatgaaatggatgcatattttacaaagaatcagcgtcgtcatcttaatgggcggcatcgcgttgtggttgaatacaacgaccgtccaagcggctgatcagagtatgaattaccaagttaaagcgaatttacccagcagtcaaaacaatcaaagtgtaacgtattttgatttaaggctggcacctaatcaggaagagacgattagtatcacggtgcaaaataatgataaccaagcgcatatctttaatatcagtccgaatacggcggtgactaatcaaaacggggtcgttgattatagccagtcaaagaaaaaagcggatgaaacggcgcctgctaatattgcctcactgattacgggggataaaaaagtaacggtaccggctcatagtagcaaggacgccattttcaaaattaaaatgcctgctaagaagttccatggtactttattaggtggttttaatattgttcgtgaagggcagcctaccgttaaaaagcaaaagaatcgcgtgacattgcgtaaccaattcgcttatgtaatcggtctgaaagtgaccgaaagtgatgccattgttgcgccaaatctgaaactgaatcacatcaaagcggggctcgttaactatcggacagcaattacggctaatttacagaatacaaaggctgttatgatcagaggcttgaaagttgatgcggtggttaccaagttaggctctgatcaagtgcttcaccggacagtcaaatcagaccttgcgatggcaccgaattcgaactttgagtacgccatcaactgggataatgaagcgctgaagccgggcaaatacatgcttaagctagccgccactgataagtcgggcggtaagtggtattttacgagtcggtttaagattacagagcaaaaagcccatcaagctaatgaccaagccgttgatttacaaaaaacaaccattaactggtggtatatcatcggtggcatactcctggtgctcttagttgggtatattatttttctaaaacgacaagcgaaaaaagcctgattcaatgaagtcccaatcctgagcgcgtcatcgattagaatggattcgaaaataatcccttgataatgaatagatggaagtattatctctattcactaccaagggatttttatatgtgctgcgttattggttgttcggttaattaggtttaaaaaagaggaaatggattttatatcacgttatttacgaatgatattcataaacagtggttttttgatgccatttcacgtataataaattaaaaataaattagagatgaggcaagaatattgatttcgatcgaaacgacactagctgggtaccactttgataactgtttcatgaacgcggcgggggtttattgttatgatgctgctgagttaaatcaagtgcaggcttcaatggcagggactttcgtgaccaagagtgccaccgttatgccccgctctggaaatccagaaccacgttatcaaccaacgcgtttaggcagtatcaattcaatgggcttgccgaatgaaggcctaccttattatttagactatgtgagtcaacagcaaaaggcagtgccagacaagacatactttcaatcgattacgggatttaatattgaagaagacaagcaactgttggcacagattagtgcttctgattttaaaggtgtggtggaattgaacttatcttgtccgaacgtaccggggaagccgcaaacgggctatgattttgaaatggtggaacgaattctaacgcgagtttttacggtttatcacggtccattaggcgttaaattaccgccgtactttgatatcgtgcattttgatcagatggcggcgattttgaatcaatttccattagcgtttgtcaattcggtgaatagcattggaaatggcttgaaaattgatgtggcaactgaacgggttgtgattaaacctaagcatggtttcggtggcatcggtggcgattatatcaaaccaaccgccttagcgaatgtccatgccttctatcagcgtttgaatccagccattcaaattattgggactggtgggattaaatctggtcaagatgcatttgaacatattttatgtggggctagcatggtccaagttgggacagcgcttcaaaaagaaggccccattatttttgaacgtttaacgcgcgaattacagacaagcatggctcaaaaaggttatactaaactgtctgactttagaggcaaattacaatatttagattagttgaaatgaggatttacaatgcagtatcgttatttattttttgacatggacaatactttattcgattttgatgcggatgaagatcaagctttggcccaattattcaaagatcaaggggttcaattgaccccaacaattaagacaacttatcagacctttaatcaaaacttgtggcggcagtatgaagaaggtacgttaacccgggaaatattattgaacacacgctttgcaaccttctttaaagaacagtttaatcaggaagttgatggaccaagattgtcccaaaattatttagacaacttggcattaggccatgatttaatgccacaagcagaagctctgttaaaggcgttaaaagcagctaacattaagctatatgtcacaaccaacggggttgccaatacgcaatatcggcggttacaagattcaggattaatcacatatttcgatgccgtttttgtttcggaagagttgggatatcaaaaaccagatccacggtatttccaaagtgtcttccaacaattagaggggatctcacaagcagaagctttgattgtcggtgattcacttacttcagatgtgcaaggtgggcagaacgtgggtgtcgccacagcgtggtataacccgaaccagctagcaaatcaaatgacagacatacagccaacacacgaaattgaacacttaatggacttattggcaatttaaaagccgatttgcggcattcaagaggagtggataaaacatgaaaaagcaacgatattttagaattagcctaggttggcgaatcttaattggaatcggcctagggttagtggttggtcggtttttctaccatgatcaaaccgctatctcaatcttacaatcaattgggaccttgttcatcaatttaattaagatgattgtgttaccaattgttgtttcctgtttggtcgttgggattgccaagatgggtgatatcaaaaaactcggccgaattggtggtaagacgttattgtatttcgaagtgatgacgaccttcgcaattattctcggattagctgtcggcaatattactaaaccaggagcgctgattgacattcatagtttggcacatggctcaattagccagtacacagcagccgctaagactgctggaaatcatggcttgggtgatatcatcatggatatcgtgccaacgaatttctttgcggccttggggtctggtgaaatgattccggtcatcttctttacggtcatgttcggtttaggattggcgacctttggtaaaaaggcaaccccgctcatcgatgcttttgaaatgatttcagaggtcatgttcaagatgactaactggattatgcagttagcaccaatcggggtgtttgcattaatcggggttacaattgcccaattcggatttgaagctttgaaaccattgctctatttcatcatcgtttgttacgcaacgatggcatttttcgtggttgttgtggctgggttggtcgcgcggatttggcacatcaatatctttgaaatcttgaaagttttcaaagaagaattggtgctagccttttcaacggcgagttcagaagcagcgttacccaaagtaatggaaaaagtgcaaaattacggtgttagtcaagggattgcttcttttgtcattccaacgggttattcatttaacttggacggttcggcaatctaccaatcgctagcggcgctgtttttggcgcaagcctatcacattcatttaagtctcacccaacaaattactctattggtggtcttgatgattacctctaaagggatggctggggtccctggtgcttcattcgttgtcttattagcaacaatcaccacaatcggtgttccggctgctggtgtggccttcattgcggggattgatcggattgtggatatgggacgaactgccgttaacgtaatgggaaattcattagcagcagtcattattgccaagtcagagaacgaatttgatgaacaaaaacatcaacaatatatgagtggcaatgaacttaaataaagcaaagaccttaaatcaatcgatttagggtcttttttgtataaaaaaacgattttagcacaccgcaaacattagcggtatctaattataaaagcttaagtaatgcgacttttagcgcttttttgtcgattatctagaacaatttcgcagataatctaaaaatgattagacagattagaattttgtggtaaaattaatccagtaaagcgttttaaaaaataaaaacgtggaactgttaactcagtcaataatgtttaagccattatttttttatattaattgatagcgttttattgatgagtatgacaactatttttattaaggaggtttttgtgaatggttggaatcgttattgcaagtcacggggagtttgctaaaggaatcatgcaatctggctcaatgatttttggcgaacaagaagaagtacaagctgttacttttatgccaaatgaaggaccagatgatttgaaagcgcatttagaagctgccgttgcaacgtttgatgcagatgatgacgtcttattcttagttgatctttggggaggttcaccatttaatcaagctaatgggttgttcgaagcacataaagataagtgggcaatcgttacaggattaaacttaccaatgttgattgaagcttacgcatctcgtttatctatgacatctgctcatgaaatcgcagcacatatcattgatgaagctaaagcaggggtacgggttaaacctgaagaactacaaccagaagaagcacctaaggcagaagccgcacaaacgacttcaaactcaggcacacctggtaagttcaaatatgtcttggcacgaattgattcacgtttattacatggtcaagttgcaacgacatggtcgaagacaactaacccaacacggattatcgttgtttcagataacgttgctaaagatgaattacggacaaacttaattaaacaagctgctcctggtggcatcaaagcacacgtcgtgccagttgatcaaatgattaaattggcaaaagatgaccaacactttggtaaggaacgtgctttgttattatttgaatcaccacaagatgtacttagagcagttgaaggtggcgttccattagaaacaattaacgttggttcaatggcgcactcaactggtaaagtgcaaccaaatactgttttggcttttgaccaagatgatattgatacctttgaaaaactaaaagctaagggcatcaagttcgatgttcgtaaagtgccaagtgactcaaacggtaacatggatagtatccttaaaaaagcacaagcagaactagacaaacaaaataacaaataacatcagaagaaattggaggattaataatcatggatttgaatttcattcaagtgattttggtcatttttatcgcatttctagctggtatggaaggtatcttagatcaattccatttccatcagccagttattacttgtacactaatcggtcttgtaaccggtcaattactaccttgtcttatcttaggtgggtcattacaaatgatcgccttaggttgggctaacgttggtgccgctgttgcacctgatgctgctttggcatcaatcgcatctgcaattattttagtacttggtggccaaggaaaagccggcgttacatcagctatcgctatcgctgttcctcttgccgtagccgggttattattaacaatcatcgtacggacattagcaactggtatcgtgcacatcatggatgctgctgctaaagaaggtaacttccgtaagatcgaaatgtggcaatatatcgctattatcatgcaaggtttacgaatcgctattcctgcaggcttaatcttagcaatcggtgctggccctgttaaagaaatgttgacagcaatgccaatctggttaacagacggtttagcaatcggtggtgggatggtcgttgccgttggttacgcaatggttatcaacatgatggcaactaaagaagtatggccattcttcgcaattggtttcgtacttgctactatctcacaattgacacttatcggccttggtgcaatcggtgtttcacttgccctattatacttagccctttcaaaacaaggcggctcaggtaatggcggcggttcaaatactggtgacccacttggcgatattatcgacaactactaagaaggaggctaacaattatggcagaacaattaaaattaacgcgtaaagatcgtatttctgtttggctacgttcaactttccttcaaggttcttggaactacgaacgtatgcaaaatggtggttgggcttactcattaatcccagcaattaagaaattatacaaaacaaaagaagaccgggcagctgctttagttcgtcacatggaattctttaatactcatccttatgttgcttcaccaatcatcggggtaactttggcacttgaagaagaacgtgctaatggtgcaccaattgatgatgttacaattcaaggggttaaagttgggatgatgggacctttggctggtatcggcgatcccgtattctggttcactgttaaaccaatcatcggtgctttggctgcttcacttgctatgagtggtaacattcttggcccaatcatttactttatcgcttggaatgctatccggatgtcattcatgtggtatacacaagaattcggctaccgtgctggttcaaagattacagaagatttatctggtggtattttgcaagacatcacaaagggtgcttcaatccttgggatgttcatcttaggttcgttggttaaccgttgggtatctgtcaagtttacgccagttgtttcatctgttaagttggacaaaggcgcattcatcgactgggataaattacctagcggtgctaagggcattcaatcagccttacaacaacaggctcaaggtttgtcattgacaagcaataaagtgacaacgttgcaagacaacttggacagcttgattcctgggttagctgcattaggattaacattattctgtatgtggttacttaagaagaaagtctcaccaatcgtgattattcttggcttattcgtagtcggaattgtcttccatctattacacttaatgtaaaagagtgcgcaataagctgggtatcttctgaggattagcctaatcaggcgaattaccaacaaagtcggtgatttggcaaatttggttaaccgcaggaatatgcctactgaagcacgtttagaaaacaaaggaggggctaggacaaagtcaatttgtcctagcccctcctttttataaaagcgtataatgaaagtaagtttttggaaatggagtcgatattatggttcaatcgattaatacaaaggtggacttagtgattaaagccacgtcgtttacagcactctctgattatggacaaatcatgatcggggatagagggtttgaatttttcaatgatcgtgacgcacgacaatttattcaaattccatgggaagaagttgactatgtgattgcatcagtcatgttcaaaggcaagtggattccccgctatgctatccaaacaaagaaaaatgggacgtatacttttgcttcaaaggaacccaaaaaagtgctccgcgccattcgcgagtatgtgcccgcagaacgcttagttcaatcactaggggtctgggatgtgattaagcgtgtgtttaaacgcaaatcaaattaacttcaggaaggtgtgatcaatattggtcacaccttttttgaatcgaattgcctgtgattttaattggtaccgatttgagtggcgtgctagaatatcatataaggttgattgttcaacattttaaaaaattaagttaaatgaggtaatgatcatgggatttgatgaagcgattaatgcaattaaggctggcaaaaaagtggtacggactggctgggatggtccagaattatttattttccaagtggccgatgggacattcgaggggcaagcaattagtccctacctattaattaaaacaaccgaaacaccagcatactcaatgttccaaccaacatcgtgtgatgtattggctgatgattggcaattggtcgactaatggggcattttgcagatttagcgactaaaaccattttaattaccggggcggcatcgggaattgggcgcgctcaagtggccgcttttttagcagagggggcattggtgttagcacttgatcgccagccgattgaagtccctgttgatagtcggtgcatcacagcgcaggttgatgtttgtgatgaaacgcaattaacaatgacattagcgactttgctggcagaatatggcccaatcgatgtggtctgcaacacggcaggtgtgttggatgcttatgcaccaacgcttgataccagtagtgcggattgggatcgaattatggcaacgaatttaaaaagtcaatatcttgtaacaaatgcgatcttgccaacaatggttgcgcaaaagcgtggggtattcgttaatatggcttcgattgctgggctagttgctggtggcggtggtgcggcttatacggcatcgaaacacgccatcattggctatacaaagcagcttgattatgattacgccgctaaagggattcgcgccaactgtatcgccccaggtgcgattgagacgccgatgaacgcagccgattttgcggggactggtgagatggcacaagaagttgcccgtcagacaccagcggggcgttgggcgcaaccaactgaagttgcgaacttaagtgtttacttggcgagtgaggttgcggattacattcatggtaccgtcgttccaattgatggtggctggattgaaaaataacgctgactaaggagattatgatggcaaaacaaattaaattaagtcaaaccgtttatgaattggtaacggcctatcctgaagtggtgccagtgcttgttgaaatcggacttgatggggtcacgaacccagcgcttttgaatactgcggggcgttttatgacattgcctaaaggggctaagatgaagcaaattcctttgacgacgattatcgctagtctagaagcacaaggattcgaggtgttagctgatgactgagcaacagtatagcagtgcgtaccgccaaaaacgaatcgtggagatcttaaaaatgctgcatgaaggtggctcgtttgaagaggctaagcggatttttgatgagtccttctctggggttgatgtgtctgaaattacgtctgctgaacgggaattgattgccagtggcttgaacccgatggagattcaacatttgtgtaatgtccatgctgcggttttcaagggggcgattaattcaaacggggctgaaacgccggaacaagaacagccaggacacccagtcgctgtgatgaaattagaaaatttggtcatgaactcgctcttaaatgatgaattactgccatgtttgaagaaatggcagcagtcagggactgatcaaaattatctcgtgcggatgcaacaagcgttaaaagatttacagttgatcgaccgccactatttacggaaagaaaacttaatttttccgttgatggatcaatatggaattactgcaccacccaaagtgatgtggggtgtggatgatcaaattcgggggttggtgaagacgacctatcaaatggtaactgcggaaccaattccggataaatatgcaattgaagcagccgttgaaaagatgagcaaagaaattcaagaaatgattttcaaagaagaagaaatcatgattccgatggttaatgaagtctttacaccagctgactggggactaattgcttctgaaagccaaccaatcgggtataccttaattccagacccattaccatggcaaccaagtgctgaagctattgcggcggccgaaaagcggaccgtgccgaagattgcgcaagaactgaatgcgatggcgcaatcgttggcggatgcgcaaatgacgacccaaacaacgccaccagaaccggcaccaacttcgatggcggcagcggctaatattccgtttgaaattcacggacaacctgtaccaaaagcccccgctgaaaaagatgaaggaaaaccagaaatgcctgattttgtgaaggcaatgttagctgacgagaaagaagcggcaccaaaagcgaaggttcaagcacgtcgagaagcaccacaaccccatatcgaaattggcgtggataaccaagctaaaatcgttctaccatctgggtcgatgaatattagtgaattgacggcgattctccaagtactaccgcttgatttaacctttgtcgatcaaaacgatattgtgcagtggttctcagataacgagcatcgtattttcccaagaacccgggcagtgattggccgcgtggttgtgaactgccatccaccaaagagtgtggataaggttgagaaaattttagcggactttcatgcggggcgagaagaccatgctgatttttggttgaacttccgcgggatgttcgtctatattcgctattttgcggttcgtgatccacagggacaatacttaggctgtttagaagtcagtcaggatttaacggaactccgtgcactaacaggcgaaaaacggttataaaaatgcattaagaggagaaaagagatgcaacaaattatcttattacttgccgtcggtgttttagccggcgtgttgggttcaatcttagggattggtggcgggatcattgtaacccccgtattaacgctagcgattggcctagatattaaatacgcgattggggccagcattattgccgtgattgcaacaagttctggtgcaactatcgcctatttgaaagatgatatgctcaacttacgagtggcgatgttcctagaaattgcaacgaccgtcggggcgattatcggggcgttattgaccggcatcgtaccaactggattcttattcatcttattcggcgcattcttgctattttcaacgtacaacatgattcaaaaattacgtggtaaagttgcagaacaacacgtcggcgctggtgaagataagtgggccaagaagttgaacttaaatggcacttactacgataaggccaaccaagaacaagtcgactacgctgttgaacaagtaccaggcggctttgccatgatgttcggggccggcattgcttctggcttgctcggtatcgggagtggggtattcaaagtgaccgccatggatacgattatgaagatgccattgaaaccatcaagtgccacgagtaatttgatgatgggggttacggcagcagcttcggccactgtttatttcttcagcggtgcgattattcccagcgttgctgcaccgttagcaatcggaattttggtaggttccactgtgggttcacggattatgcagtatttgcaaccacgtgtgattcgcatgatttttatccccattttgttatacacaggtttacaaatggtgcttaaaggattcggggtgcatatttaatgacagataaaaaagcagagatggctcaaattgaactcgtcatcggtaaaattttacgcattggggtggcggtttcagcaacgctgctcattattggcatgttacttgcgattattcatggcggtacaggttattcagaatatcaatttccaacgacctttaccgaaattttcagtggcattgctgcatttaaggctggcgctatgattatgttgggcttattctgcctcattttaacgccagtcttgcgtgtggtggtatcaatctacgcatttgctaaagaaggggattacctctacgtttggattacggttattgtgttggtcatcttaatcatcgggatggcaattggttttataaagaaataaagagtggtttattagctcagtatctcgcgaggattaaaaaaagggccaacgacaaacatgtttgtcgttggccttttttttgtggtgaattaggctaatccgcagaagataactaggcttacttactgcgcactttgatctgaaacgtgctccgtaagccatcttcttccggttagcgacatcagtcaaatcgccgactttgtcggcaatccgcctgattaagctaatccgcagaagataaccgggcttactgcgcactctattccattcctagtattcttttctttttttcttcgaattcttcgtgggtcattaggccgtcgtcgcgcattttgaggtaagccatgataagatcaccggtcttaacataactgaggtcttcttcaacggttggtttttcgagatagtccgctaaggctgtgtataacttgcgcacagcgaggttatcgtcgggttcgaaactgatgacgattttttcgagggcgtggttgggtttttggtagagaatttggagatgaccatgccgataagtcgcttcaaaaaagcggaccgattttaatttgctaaacggaatgtcacgatcctggttttgtttcttcttaaacagtccgggatagtgaattgttaggatattttcgtcataggttaattcgagtttttgaggttttttaatgagataagtttgcatcgcttgctcctttaatcattcttaagtaaaagcacggtagttcttaataaatgaagcctaaacttacctttatcatagtagacagtgaccctaaatagcaagctgttcgtattggtttatgaaatgaggtgggatgatgaaattttttatgggtattcgcaacggcctgttagtggcattaccgatttggtgtttaataatcttctcaattacgtattggttacgctaaaataaaaaaacgggcgccgcacaaaaactgtgcagtgcccgttttttaacgtaaattggctgttttttaggtctaaagacggtttttatgctagtatgaatagattacaattagtgacattgattgcatctaggcgatgtaattattataatgaaatcaaatgtccaaagataaggaggaggaaaccaattgaatattgggatatttacggacacctactttccacaagtcagtggtgtggcaacctccattaaaacattaaaagaagccctagaaaaacaagggcattcggtctacatatttacaacgaccgatccacatgttgacaaagatgcagtcgaaccgaatattttccggtttgctagtgtcccgtttgtctcatttacggatcggcgaattgctgtgcgcggcttatttcacgcttatcaagtggctaaggaattggatctcgatatcgtgcatacccagaccgaattttcgatgggctacatcgggaagtttgtcgctaaaaatttaaaaattccttgtttacatacgtatcatacgatgtacgaggattatttacactatgttttaaacgggaagttattacggccataccatgttaagcaaatgacaaaggcctttttatatcacatgtcaggcatcgtggcaccatcagagcgggtttctcaaaccttaaatggctatcaagtgaaggcccccatccggattattccgaccggggtcgatattagtcgctttgagcgcgaagtgacccgcgacatacgggccgaattgggcttgacgccagaacaacctgtgctcttatcattgagtcgcgttgcttatgaaaaacggattgatatcttagttgatgcgttacccaaactagtcgcccaaacaccagatttaatgttagtgattgttggtgaaggtccagctcgagaagatttagaagctcaggttgccaagttaaacatgaccgaccacgtgattttcactggaatggttgataacgatgaagttgcaaattattatcatatggcgaatctttttgtctccgccagtgactctgaatcacaaggattaacttatattgaagcgatggccactgaactcaagattgtcgtcatgacaagtccatatgcggctgagttattaactgatccttcaattgggacgacatttacgaacgaagatgaaatgatccatcaagtatcgaattatttgaatcatccacatgcatttgatgatccagcaccgcgccgaaagaagttgcatgctatttcggcggattactttgcggaacagatgattcatttctataagcaatcacagctattatatgacgaattaaagttagaccaagatgatttattggaattagaagatttagatactaaaaaataagtcgcgttggcggaaaactgttgatcatttaatcaacagttttttcatatcgttgctaataacaagaaaaagggtcgtttatgagtagaacgaataagattgtttttgcagtcatgctgttgattgggtgtgggatttttgcctatgaaagtcgcacgctggcgttgaaacagctgtttatcgatattagtcatctgaaactttggtggctgttggtcgccttattatgtatgttaatttcgtggtttttcgaagcacttgtcttacgcgtctttctaaaagaccgcacagaacacttttctttatacaatgcgcttcggattccgttgattgcacaactattcaatgcgattacaccgttttcttcaggtggacaaccggcacaactggtagcgttgatgcaatcccgtgtagaagctgggcaagctagctcagtactgctgatgaagtttattgtttaccaattcatggtactggtgaatttcttattaagtatgatgattggtttctcgcaagtttccaagcattttgggacgctgtcgattttgattactttcggattaatcgtgcatgtggttgtgttagccgtattgttgctaatcatgtattacaatcgatttacgaaacagttagtgcactggttattaattccggtgggctggttcgtctcccaaaaacgggtgacggaatggcggacaatgttaatggccaaaatcgataccttttacgcggagagtctacaccttaaacgcgagaaaaagaaactaatcaagggctgtattttaacccttgggcaactttttttctattatagtgtgccatactttgtcttattggcacttggcatcccgcatgttaattatttagaggtgatggtcttacacatcatgattgtcatgattgtctcgctctttccagttccaggcggttctggtggggcagaatatagttttaagacgttatttgccacttttatcccgagttcaagtaaactggtgttaggcatgttgctctggcgattgtttacgtactatctcgggatgttcatggggattggggcgttagcagttaaaccacgagtaactgataaaaagtaggaggcgtttttgatgcaaccaacaattggcttcattggaacaggtgtcatgggtagtagcatggtcaagaatttattgaaggcagactatccagttgtcgtgtataaccggacaaaacaaaaagcggatgcagttgtggcactcggtgcaacatgggctgattcaccagcagcggttgtcgcgcaaagtcagattgtgttatcaatcgtcggttatccgcaagatgtcgaagccatctattatggtgaagacggaatttttagtgctgcacaacctggtcagattttggtggatatgacgaccagcacgccaacattggcgcagagaattgccaaaacggtagctgacaaaggtctgcaagcattagatgcgcctgtttctggtggcgatatcggcgcccaaaacgggacgttgacgattatggtcggtggcgatcaagctgcctatgaaacggcattacccgtttttgaagcaatgggtaagactgtccatcgcttcggtgctgccgggacaggccaacatacaaagatggccaatcaaatcatgattgctggcacaatgaccggaatgacagagatgttagtgtatgctaaagcagccggattagaactagaagcggttttaaacacggttaatggtgggagtgctcagaactggagccttgcaaactatggtccacgtattctagcgcaagactatacaccaggctttttcgcaaaacattttttaaaggatttaaagattgcattaacggaatccgaaaagatggggctccatttaccagctacgcttcaagctaagaaactctatgcgcagctcgttaatgataaacaattaggcgacgatggcacccaagctttaattaaattatggtggccttctgcaaaataattggatataaacggtgcagaagtgctctttttctgataaactgatagttagttattaaaggaggcttcgccatgcaatcatcacagttagttgcgattatcaaacgtctggtagcaatgcaagaagatcaaagcgctgaggttcaagaaagacgttttgaaaaggacggcgatttaaaagcaactgttagctatgatcctcaagctcaagcatttgaacttgaagacagcaacacacatcaacaattccaatttgacaatattgatttagttgcaatggaactatacgatttattagcagactagttaattaaccattgagtatcgaattacttgatggtttttttgctacttaagcaggtgatagccttgctcagttgcgactcagattattaaaaatggtttaatatttggcattcaagccggttacatattgcttttcatttcacggatgtgtaaactaactttcagattgtcaacggcttttaaagcccaacgacctttaacggaggctactgtatcgatgaaacaaattggtcataaaattcaatcaggattaagcacacgatggggattcttccttttcgcagttgcgctattctggcttaaaacaatttacgcatatcaaacaaaatttaacttaggcgtcaaaggtggcatgcaggccttcttaatgacgattaatcccattccaacaaccttattgctatttgggattgccttgtttatgaatggccgaaagtcatacattacgttgattattattgatttaataacctcaacttggttattctcgaatattttgtattaccgtgaattttcagacttcttaacgtttaacttaatgaagggctctggtgcggtatcaaataacttgggcaagagtattgctgggattattgaatattctgatttcctagttttcgctgatgttttattgctaatcatcttattggctactaagttagtgaagattgatcaccgtgtctttatgaagcggaatgcatttgcaattactgggttagctgttgtgttattcggtgccaacctcgggattgcagaagcagatcgttctgggttattaacccggacgttcgataacaactacatcgttaagtatcttgggatgaatgcatacactgtctatgatggcgtgaagacgaccaagaataatgcgattaaggctaatgctgatagtagtagtatgagcagtgtcttgaagtatatgaaggacaaccgggttgcacccaatgttgaatacactggcgtggctaagggtaagaacgtctttgttatccatttagagagtttccaacaatttttaattgattataagtgggacggtcaagaagtcacaccaaatatcaataagctatatcacgaccaaaacaccctcagtttcgacaatttctttaaccaagttggtcaaggtaagacggctgatgctgaattaatgctcgaaaactcattgttcgggttacctgaaggggccgccatggtcactcaagggacaaccaataccttccaagcagcaccatcaattctagatcaacaaggttacacaaccgcttcattccatggggatgtgccaagtttctggaatcgggataatacctacaagtcatggggctatgattacttcttcagttctcaatactttaaagaaggtaaaggctacaacgtgggttatggcttgaaagataagatcttcatgcaagactcagcccaatacattgaacaattaccacaaccgttctatgctaaattaatcaccgtgacaaatcactatccatacttattggataaacaaaatcaatcaattgctaagaccgatactggtgatgatacagttgatggttatgtgcaaaccgctaagtatttggatcaatcaattggtgaattcttagcttggttacaaaagactggcttagataagaatagtatgctcgttctatatggcgatcattatgggatttcagggaaccataagaaggctgttgcgaagttattgaatcaggataaatttactgattttgataatgcgcaattccaaaaagtaccgttcatggtgcatatggatgggttaaaaggtggcgttaaccatacctatggtggtgaaattgacgttttaccaaccttattgaacctattaggtgtaaaaaatgacgataccatccaatttggttcggatttacttgcgcctaaccgcaatcagacggttgtctttagaaatggggactttgtcacaccacagtatacgaaggtaggcagcacctattacgatacgactaatgggaagacgctgacgaatttaacggcagcgcagaagaagcaattaacggcaatcagtgaacatgtaacggaagaattgtcactttctgacaaggtaatcaccggcgatctacttcgattctatacaccacaaggattcgaaaaaccagataagtctaagattagctacaaggtgaaagatgctaaagctaagttgaaagacagtaacaataaaatgagtgttatccagcaaaataatggtaagtcaacaatggacctttatgaaacggatgcacctgaattgaagtaaagtatgtaaagacgttacgggactcacgtaacgtctttttttgagcaaagatacttgtcagtctcgtcaaaaaaaggtacgattacagcaataaggatatatgataatgattatcattagcgaaaggtggtggcaaaatgagtcacatcgtgcaacaaacgttacggaaactcaaagaacacaacgtacggatcacgccacagcggcaagctgttttggaattcatgattggcactcatatgcatccgactgcagacgatgtctataaggcgctagcagggcgctttccgaatatgagtgttgcgacaatctataataacttgcgcctgtttacctcattagggattattgaagaaatggcttatggagatgcatccagtcattttgattttgcgcagaccaagcattatcacgctatttgtgagaactgtggaaaagtagttgatgttttttatccggagttagatgatgtagaagtgattgctgagaatctaacggggtttatggtaactgggcaccgaatggaagtgcatggtatctgtccagaatgccaagcaaagcttgcaaataactaagttgtttgaatatttaaaaaaaagatgaattttatgcaaattttgcttgacgatagatttagatgttggtatagtattctatgttgtcagcgagagaaaagctcatcgctaacgaagtaacgggtcaaacgagattgaataaatattcaaaaaatatttataaaaaacaatgctgttttttaatagccggctgacaagtctaccggattgacgggtaattcacctttgtctaaataactgggtaaattttgatcgaaaattttgaagagccgttcatggatatcagcgatgtaacctgaaatatgtggcgtgataatcaggtttggtgtggcccataatggtgaatcacttggtaatggttcgttttgggcaacatcgattgctgctcctgccaaatgaccggattgtagatagtgcatcaaagctgcttcgtcgactgaagcgccgcgccctaaattgaagaagtaagcccctcgatggagttgcgtaaaaaaggtggtgtcgaagaaccgattggtgaccggtgttaatggcatcacattaatcacgaagtctgcttgtggcaatgcttgttcgtaatccgtgtcggttagaatctgatcaaaattggcaacgggtttctcgtgccgattaacgccgattgtgtgcatacccatgacgtgggcatactttgcaatttcctcaccaatttgacctgttccaaaaatgaggagtgtgcggtgttccaaatttgtcatttgttcaccaatagcatgatgctcccattgatgcgctgcttgtgcgggtaagctctgataaatcccacgggtaaagtgtaatatgtaacttaatgccgtctgtgcgattggttttgcgtgcatcccgcgtgcgtttgataccagtaccccttgcttagctaacgtggctagtggtaaataatcaacccctgagcttgcggtctgaatccattttaattgattaccgggctctgctaaaattttcgggcctacatctttattccaaccaaacataatctcaatactacccagttgacttggttttaaatcagctaaagcgatgattgttaaaccttttgcagttagtgctttgacgtgttgttcaggaattgtttctgctgctaaaatgactgtcaagttgatccctcaccttattattgaagtaatctttattataagggattttcagcaaataaaaaagcattaccgactgaaaacggcaatgctttataaaaaattttattctttttctgcacgtggccatactggacgaccccagtattggaataaatcagtttgaatccgaccattatacaatttccggcgtttagttgcgcgttgcccgaatgattcttggaattgtaagtcacttgttaaaatatacttactccaagtcttcaatgaccgataggtatcacccatttctttatacaaagcacgggcttgtgtttggtcgcttaatcgtttcccgtaaggagggttggcgatgatgaccccgttggttaaatctgtcttgaaatctttaacagcgagttgtttgaactggatatcatgtaaaacaccagcttcgttcgcattcaacttagcgatatcaatcatgttttgatcgatatcataaccaaaaatttcaagtggttggtctttttcggctgctttcgcttcggctttggcattttctaaaacagaagcatcgatccaatcgaagtcttcaaaggcaaacttacgatgcataccaggtgcaatgttgtgaccaattaaagctgcttcgatcgcaatggtcccagaaccagtcgttggatcaacaaatggcatatcaggttgccaacggcttaaaagaattaaggatgccgcgaagttttccttcaatggggcttcccctttttcaaggcggtagccccgcttgaataaactaggaccggttgtatctaagctgatcgtcacgacatcttttaggatgctgacttcaagcggatacgttgcgcctgtttcagctaaacgtgttcggcggtgatagacagtacttaacttatcaacaatcgcttttttagtgatggcttgcacgtctggttcgctatggagcgttgaacggactgagcgaccagcaactggaaaagcggcgtctaatggcaggaacttgtcccatggcaaagctttcacttgttcaaaaaggtcatcgaaggttttggcctcaaattgaccaatcgcgattttcacccgatcagcactgcgtaaccagagattggtttttgcaatatctgccacatcgccttcgaaatacacccggccattatctgaacgtgtttcataaccgagattttgtaattctttggccgtaatggattcaatcccactcgccattgttgcgtatagttggtaagtcatgtttttaaagatccccttaggaaattattttttaaataaaaagagcttgggcaaaagcccaagccacctgattgtaaacctttataggccatgttttgttccagaacttccccaggaagaaagttccttcagtaatcatctatctgttcttacgaactctcatttttagttcatttccataaatgagacgcccctaccaaagtttgggttactcgctcgcggggtttacctcgttccaccgtccaagtttccaaggacgctccgtcactgtggcactatttaaggatattcacgcatgaccgaagttttagcgctttttccgccgttaccgttaaggtaccctggcttattgggccaggcacgaacactacaagcatctcagcctgtgcgggcatggaccttcctcagcctaccgatgtagaccgcgattactcaagatttacaaatgttgaatcaatgtttataagtatagcacaagattaaagatttgtctcgtcaaattgtgaatgattttgaactcttgtctgtggagcttgattttgttcacttaacttagcaccgaacacgtggcgttcaaggtttgataagcgtttcaaaatatcatagttggttgctgctgaagcttgttgtggtgcactttccttcacgttatcagaagcgctgagttggcggtttaattcgtcaaccttcttgaataagcgggcattttccgccgttagccgattgattgcttcttgataagtttgatagtctttaataactaaatcaaggtaaccatcgacttcttcaggttcatagccccgcatttttgttttaaattcttttttcaatatatcagttgggttcaattcgatttcaatttgattgtccattttgacacctcatttagaataaatgtactatgattcccattatagcaaagttatcagataattaaaactcttgctgatctaattccgctaactcagtcgcgatatcttgtagttcgaaaaaatcgaccaagttaatcggataatcttgttggtcttgatattggcgggctgcatgataatcatattctggtttgcccggtgattcacgatcatagtataatagttgaccatccgtatgggtcagcatgaattgttgatactggcgcaattgttgcggtccagaatacggtgcgttaatcactggttcgcaaaaatcgactcgcgctttgagctgactcaattgagcttggttattttcgttccattgttgaccaaaatcattaaacggcaacatcatcgccaattttaaatccggatagtccgtttttagttcaatagcaacttgcagactccactgttcaatccccatttggccaccagtgatcacccactcgagcccatcatctaaatattgtgttaactgcttttttaaggaatatttaattactttaagtttctcgtcagtttcgccaaaaacaccgagttcatagcttcgatagccgctcacccatagtcgtttcaagtcaggtccctcccaaatgattttcaattaaactaaacattgctataatagtgaaacaggagtgtgattttcaatggcctttcattatcctaacggacagccttatacaaataatgagacaaaaccaactaaaaagcaagcccggcaaccagaagcaacaacgttatttggtaaacgcggcatgacgttggaagaagaactcaatgatagtaatcagtattatcgattacatgcaacggctgtcgtgtataagaaaccaacgccaattcagattgtgaaggtcgactaccctgcccgcagccaagcggttattaaagaagcttattttaaacaagcctcaacaactgactataatgggatttatcagggccgttacgtcgattttgaagcgaaggaaacgaagaataaaaccgcgtttccgtttcggaacttccatcaacatcagattgaacatttcagagcctgcttgaatcaaggtggcatctgctttgtcattatgaaatttgtcccgctacaacggctattcttgtatcccgcaacagaactgattagccgctgggacgcgcaagttgatggtgcacgaaaatcgatttcactcagtgatgtgattgacaatgggattgagattaagtaccaacttaatccaattattccctacttagatgccgtagatcagttattaaagcggtcaaataaaggagtttaaagaacaatgtccgataatcgaaacaataataattcgcgagttgcaaggcacaaagctgaagcaaaacccgctaataagaaacgccggcccctctttttaagaattctaaaatggctgttactactgattgtagtggctttcgtggctgggattggtttgtttgcctactatgttaaagatacaccaaacctaacgcaagcggacctgcaaagtccgaatgcgacaattctatacgatgatcaagggaaacctttcaaaacaattggtggtgaaaatcggagttatgtcaagagtgatcaaatcccgcaaacattaaaagatgcagtagtctctattgaagatcgtcgtttctataaagaaaaattcgggattgatccaatccgaattgcgtctgctgcagtcgccaatattactggtaaatcaccgctgggcttacaaggtgggagtactttaacccaacaattgattaaactgtctaaattctcaacgaaaaacagcgatcagactttcagacgaaaagcacaagaagcgtggcttgccgttcaagtcgaacgtcaatattcaaaagaccaaatcttagagtattatatgaacaaagtgtacctgaataacggggtcaatggtatggggacggctgctaagtattattatggcaagtcgttgaaggaattaagtttgccacaactggcattgattgcgggtatgccgcaatcgccaagtaattacgatccgtacctccaccctgatttagcgaagaagcgccgtgatttagttcttgatgcgcttttgcggaacaataagattacagcaactgaagctgccgaagctaaacaagtcccaattaataccggcttagtggatcaacaaacagtagcgaatagttcaacggattctaaagcaaccgacgcttacgtcaaggaagtcctcgccgacttgaagaaaaaaggctatgatccgtacacggctggtttgaaagtctacaccaatatcaatatggacgcgcaacgtaagttatacgatatcgtcaataatgatagcagtattccattcccagatgatcaactacaaacagcagtttcaattacagatcctaataacggtcgaattgttgcgatgattggtggtcgtaaaactggtgatgtgcagctcggttataaccgggccgtgcaatctggccgaagtaatgggtcatcaatgaaaccattaatggattacggtccagctatcgaatatcttgactactcaaccgcacagaaactacaagatgtcccttacacttatcctggaaccaatattcaattgcataactttgatggccgttatctcggtacaattaccgcgcgtaatgcgcttgccaactcacgaaacgtcccagccatcgaactgttagaagctgttggcatgactaaagcccgtgaattcgtgaaaggcttaggcattaacgtgccagctgatactggtctttcttatgggattggtgggaatgtttcaactgttgatgaagctgccgcatatggcgccttcgcaaacggtggaacttactatgcaccaacttatatccataaagtcgaaacagccgatgggattacgcataattatgattctgatggcacacaggctatgaagagttcaacggcctacatgattactgatatgttaaaagatgttattaaaaatggttctgggacgttagcccaaattccagggcttcatcaagctggtaagactgggacaaccgattattctagcgaagaaattgccaaatctgggttaaacccaactttagcgaaggatagctggtttgccggttataccaagaactattcagtgacggtttggactggatacgatgaaccacttaaaaatggattaacaatgagtgagcggaacgtcgccgcttatatctataaagcaatgatggcctacctcgctcaaaacgcaaccaactcagattggtcaatgccaagtaacgtggttgctaaaaacgtggctggcgtacgagaactctatattaaagggacgacgaccattccaagttcttcaagcagtcgatcttcttcaagtagtgtactctactctagctcagaagcaccggtcagctcaagcagtgaaatttctagctcaagtagcgtggttgaaacaccaagtgaatcttccagtgtgccggagacctcatcttcaagcaccccaactgaaagttcacaatcgcaaccttcgacctcaacccctccggcaacaactaaatccaggaacggggtcgacgacacaaacaccagcagcgccaactaactaaaagaagcaccgttcagttcaacgataaacgttggctgaacggtgctttttttgcgttttttaaccacgatcttcaagaaattgttggcctgcttggcaaatccttaataagggacactcatcgcaatgcggcttacgtgccgtacagacttgccgcccaaaaagaatgagtgtgtggtgcgcttgaacccatgttttcttaggaagcttcgcttgaaagtccttttcaatctggatcaccgaggcattctgtgcactgattttgagccgtttggcaatccgagtgacatgcgtatcgacggcaaatgatgggacgttaaaggcgtcacctaaaacgacattcgcggtcttacggccaacaccagcaagttgttccaattcggcatgtgtgcgcggcacttccccaccaaaatctgccattagttgctggcagcatgttttaatgtgtttagctttattatgatataacccgattgaatgaatatcagcttcaatatcggcaatctctgcattcgcgaaactagctggtgtcgggaaatcagcaaatagttgtggggtgaccttattgacggaaacgtcggtggcttgtgcgctaagcatcaccgcaatcaacaattgaaacggtgaatcagcaactaatgcgccctgcgcatctggaattaaattgtatagttggtgcatggcccactgtgttttggcttttgataacatccgcttcatctcctattcgattaacgtcttggatgggccttttggtaagcttgtagggattctttatcagtaatattttgtttctgccagttgagcaaaatcttatcaacgtacttcaaggaatagacttgatttaaaacggattctcgcacggctaattgaatcaattctggttgataatgatctaaatctaaccagttggcaacaatctcagattccaatggcgataatgggcggccaagagcttgttcaacttggttaaagaccgcactccgttggttaccgtctagtgcttgttgagtgacttgtgcgtcttgaacggctagcacgctcaatttagttaaggctggtgtgagatcgtaatggtcttcagccttaccttgttcattgacagatgatttaagggtaattagttttttctgtaaaagttgatgaatcaatgcgtaaatttggctggattcaattcccatgcgttcaccaatcacagctaaatcgggaaagtcattgttttgactggcaaaatcactgagctgtaagtaaaccactaattcttcagaagacatcttgagcgtttgatagtgatgcagtaacagtcgagagacactcaattggccgccttgtaaaaacgcggtaagttcgttcatattctagccttcttttctaaaagtttcattagttctattgtaaccaattttagacaaataaaaaagcgccgagaacctgatttcggttcacggcgctttagttaatcctcaaagccaactcgtttgagtcagcactctgatttgaaacatgcttttgaaagtagtcctcggtgctttgctacgtccagcaaacgatcgacttgcatcgctcattcactagactagacaaatgctcgagaactaaccactttcaacgcactctaattcaaacgtgcttttgtagctaggttcctgcgcttaacaatgattgtcaaataatcgattgcatcgattattcgccaaccaacgttaatgctcagaacctaaccagctacaacgcactctatttgaaacgtgcttcttcgaactgccttttccggttaactgtaaaacgggcaccatggctgtgaagcgccataatgcccgttttgctgttaatcctcaaagtcaactcgttcgagtcagcactctttatggtttgattctgttaatcattcttgggaatggaattgtttcacgtaaatgatcgataccacagatccatgtaatggcccgttctagacctaatccgaaaccagaatgtggcactgatccgtaacgacgtaagtctaagtaccattgatattcttcaaggtctaagcccattgctttaatttcagcttctaatttatcaaagtcagtttcacgttcactaccaccgataatttcaccataaccttctggtgccaataaatcagcacataagtaaacatcatcacgtgttggatgtggcttcatatagaaaggtttgatggcttttggataattcaaaatgaagactggttgttcaaattgatccgataaataagtttcatctggtgcgccaaaatcatcgccccatttaatatcgaagtcagctgcttgtaacatttcaacagccttatcgtatgaaatacgtggatacggtgttttagtatatttcttcaattggtcaacatcacggtccaataattttaattcataggcacagtgatcaatgacgttttgaacaaggtaagccacgtatttttcttggacttcaagactttcatcttgagttgtgaaggccatttctggttcaatcatccagaactcagtcaaatgacgacgagttttggatttttcagcacggaaaacagggccaaaagtgaagactttgccaaaggccattgcgccagcttcagcgtataactgaccactttgtgttaaataagcatcgttgtcgaaatattcgatgtggaataattcagttgtcccttcaggggcactacccgtcaagattggtggatccatcttgatgaagccttcttggttaaagaattcataagaagcgcggatgatttcatttctgattttcatgatcgcaaatgggcgttttgaacgtaaccataagtgacggtgatctaataagaattcaatcccatgttctttaggtgtaattgggtattcgctgctgtcaccaattaattcgatgtcagaaatttcaatttcataaccaaagtgtgaacgagtatcttcatgaatgacccctgtcacccacatacttgattcttgtttgacatcttttgccaattggaaaacggcttcgcttacttggcttttaacgacaaccccttggaaaaaggcagtgccatcacgtaattggaggaatgaaatcttcccacttgaacgtttgtcggttaaccaaacgccaattttaacttcttcatcgacatggttttttgcatcgataatactgatttttttaaccataaactctgtctccttatgtgcaacatttaatttacaacagttcaaaataactgatagttattattatataacaaaaccctgacaaccacagccccctaattgagaaccctagatattttcaatcaattgaatcgtcttcccggttttaaaatcgagggttaaataacaaagacggcctttgtcacttttatagacaacttcccaaacaggcttgttgcggtacataccgaagttaatgttcagtactttttgcggatttttagttgaccatgtcttttctaacgcatcgtttttagaaataccaccactttgatgatagacagtggcatgattgcctttttcgttgattaaaacgaagatgccgtgattatcacggtctttaccactaacggtataatatgttgcatttcgatgatacgtgtagaacccatcaggctcttttaatttcgcgtattttttagcaatgttaacggctttggtttcagccgttgcttcgggttttcgagcttgatgataaatcatcagcatgctggcaatgattaccaacaataagaatatccagagccatctcttatatttgcgcacgctgcattctctccttgttcgcttgaataagccttattatagcaaaaaataacggctatcggcgcttaaaaccgaatcttagtgggaatttaaccaaaacaagtcggttaattcccggattgttttaaccgacgctgctttttggggcaaacttgtcggtaacgcacggcgcatttgttgcccatattgggtcgataacagccggggatctaaacaaatgaagacgccgcgatcgttaggggttctgattaagcgcccaaatgcttggcgtagtttaatcgttgctttgggtaaagcctctgctttaaatggattaattccttgggcagaaagttgagcgtaacgaattcgtgtctgcagtgcattcggcgcatcaaatggtaattgaacaagcaccactaattccagtgctgattccggaaaatcaacaccagcaatgaaactgcttgtcgccaacaagattgaatcgtgacccagcataaagcgcttggtaattttctccgcactacccgtaatcccttgggcaagaatctcacgatcaagcgataaaccggcgcggccaagcgcataatacacttgttctaacgcctgattagaattaaacaggactaacgcctgatgcggattgccaactaataacgttaatagctgttcagcaactgcatgatggtactcattgggggctaaattcttttgactaggaccatcttcagcgataaaaaagcgcgcctgttgcttgaagcggaatggactgcgtaatttcttagtcgctagtggttgcgcttcggtaaaaccaagttcacgtttcaaataatcgaagtgcccattaaccgcaagggttgcgccagtcaatgtgactggttcaaagtgcgcgaggatctgttgtatttgcggaccagctgaaagcaattgccactggagcttaaactgtggtaactgactaggttgtttaggctgtgtcatctgaatcattaacgcgtgttgttcctgcggtttcgtcgcaatgaataattgctcaaaccgttgataggcttcaacatccgccaacaataggttgatttcgttttcaaatgactgccaaatccccaaatcaccctctgtatattgttctaaccgctgttcaagccagtaacgcaacgcgagaaaataatcttgaatggtcaacagttggcggttcagttggtcaaattgattatgacaagcggtgacaaattgaaccacttcatctggattcaaataacgttcactaaacgcttgatgtgcttctggttgcggtagttcaaacgctgtggttaggtatgtctctaagtcactgatggttcggcctaacttggttaagtttttatgcactaaccgtaacgagcgggcttgcggtgattttttcgggaaaagccgggctaaattattattggcctgttccggatccgtatattgcaaccctttttgagaccaaagttgccaacgtgaaagtgaccaatcttgttgcgcaattttttgaacattgaaaatcatgttttgtgcttcatctaagaccaagtatggtcgcgcaccccaggtttggtgatcattcgcgtgctctgccaggtaggcgtggttcgtgacgagtagttcggcttgttgctggcgcttatgcaggcgacgtaagaagtcatcttgataaaacggcgcttgcggttgcagacttgctaatccgcggtgctgtacgttattgaaaaacggtgtttggtaactcgtcaaattgagttcatccaaatcccccgttgtcgtttgggttagccaaactaagattctcatctgaagcaaccgcaccatgcgattcttgtgtggtaagcgaagtgataattcaaagcgatgcaaatccaaatagtgacgcggactcttaacgatttcggcattaatttggcgacctactaatttttcaagaagcggtctggcctgcgttaaaatctgatcctgtagcagcgttgtcgatgttgcaaccactaatttgtgttcaggcgtcatgcgataactataggggagtaaatacccgatggtcttccctaacccggtggctgcttcaattaatagtggttcaggtgcctcagattcgaaattatcgtgaatcatatccatcatggcagcttgcgctttacgccatttcaaatgaggttttaataatcgttttttatcagcttcttccactggataatcggccgcaaaattagatcccggatagatttcaaatgattcctccgctggttttcgcagggcaatgttttcacgaattaatagatcgttcggcagcggtctcgattgcgcatgcatctgctcagcgaccgctgtgaagaaatccccggtttgacgtaataagcccgcgcctaacgcactaagacgttctagggtaactaatggcaggttctttagccgtgccattaattttaagaataatttagccgttaccaaggcatcgctgtcagcttgatgaggattgtcatgttcgatggcgagtaactgtgtgaggtcttgtaatcgatagctcggtgcttctggcaatacgatctgagccagttcaacagtatcgatgcccggcaaatcaagtggcggttgccccacgcgttctaattcgccatttaaaaaaggtaagtcaaagttaatattatgggccacgaaaacagtaccggataagagttcaactaacgttggcgctaaatcttcgaaaatcggtgctaattcgagttgatcagcagtgatatgcgtcaaatgttgaattttagtcggtacgtcgcgaagcggattaacatcttgcgaaatcgtctgaatgattttgccgttttgaatgagggcgcatccgaattgaataatgcggtccccttctttaatgtttgtgccagtcgtttctaaatcaacgacggcgtaaattgtctcttggttcatgctgtcaccaatactttactcattattatatcaatcatactatgaatgacgcgtagaaaccagtctagttaatagcgactagttggccaatcgacaatagatagagatatttagcggttaccggccggttagcaatttgcgtcaacgcggcactgtataggttaatttggccggcataacgcgctttaatcgcctcaatggcagcttctggatcagctgggttcacaaaatcagtcttatagtcgaacaaaatacagtcggtatccgtggttacataaccatccataatcccatggattaagacattgtcttgatcttctgggcgtaaaccggcgaataagggtgcagccggtaacaacagtgaaaatgggacttcccgatgaacttgcgctggttcagctaacagttgttgccccaactcgctctcgaagaacgtcatgatagcagcaactttaatttgttgtgcaacattggcagtgaggcttttttgtaaaacaagtcggccgatgacactttgcacctgatcaatcgttactggttgggttaaatcgatttcttgtaagaccagatgcgtcgccgttccaatttcagccggactcgcttttcgaacagtctgcatgaattgtggttgaggtaattcatcggtcacgtaacgatgggtttgttgcggtgtatcagcgtcaaagcgtaattgccccaactgatcattatcgggatcttcaaagagtcgtttcacttctgaaacagactggtaagctgtcgtttcggtggcgccttttgctggataattgaatgttagctggtcttggatcccgttggctaaatcagttgttaaatcgaccgccttgagtgctacttgttgttgctggctccaatcttgatcatggtgtaaagcacctggtagttccccaaggcgcgtctcacttgtaaacgttaaattaaattcagttgcgtcgccgctcagaggtaggaatggtgtcccctcatcagtccaatcacgggcttgcggatgacgaattaaactcaatccaatccaatctagtaagttcgtactagattgacgaacagaagcgtccaatcgcagatcaggattttgctgccctttttgccaagttgctagtagttttgcttggttgtcacaactgcccgcgataatcagccgttgctcggcacgcgttaaagcaacatagagttttcgcatttcttcagcgcgtaacttttgccgtttttgggtcgtgatggttaattctggtagtgttggaatctttaaccggtttttcgcgtctaagtaaacaattccgagtcccgattgatcatcgagcacgtaattttggcgcaagtcttgctcgttaaattgatgattggcatccattaagaagaccacggggaattccaagcctttactcccatgaatcgtcatcacggagatggcatcttgattggcgagactggttggttgggctaaatccttgtcttgtttttgcaagcgttcgataaattggatgaactggaagagccctttaaagccgtttgcttcgtaagtcgcagcgcgttcatagagtgcgtgcaagtttgcttggcgttggcgacctgctggcatcccaccggcgtaatctaaaaagccggtcttttggtaaattgtccagattaaatcaacgagtggccgttgacgtgcaatggctcgtaactcatttaataaggtttggaaatgcgttaatttttcgaagacttgttggccgagttggccggatttttgtgcttcgaactgatcaagataattaaaaacggcttggtaatagtcatccgttttatcattaatccggattaatgcgagttcattttcgttcataccgacaattggtgaccgaagcacgctaaccagtggaatatcttgattgggattatcaataattttcaagaaagatagcatgatttgaatttccgttgtttggaaataattctgcgcatcactaatgacaatcggtaagccgaaccgttggaaataatcaagaatgattaggttgttgttgcgcgttggcgtcaataagacaatatcttgatagcgaattggccggatttcttgcgtatcccgatcccagatggtttcttgattatcaatcattcgtttaattcgctgtgcaactgatgcaatctgaccttcagctttatcaagcttgcccgttgattcttcatcagtcggttttgtttcgtataaaagtaattcagttggctgagttggttgatcgtcaggataataagtcgcaccatattgcaattcagcgttgtgatcgtaatctagctgccctaattggcggtccataatttgtttaaagactaagttgacgaaatcatcgatattacgccgtgaacggaagttttctgcgagaataatgcgttcactatcgttatctggcttggcgaattcgtcgtacttaccgaggaacaaactcggatcagctaaccgaaaggcatagatggattgtttaacatcccctaccatgaagacgttgcggggtgcttgaatagcgatagtttgaatgattgtttcttgtaactggtttgtatcttgatattcatcaaccaggatttcactgaatttattttgatagaacgtccgtgctgcctctgattccggagtgtcaccggccaaaatatccaaacagaaatgttctaaatcgccaaaatccagtaaatggcggcgtttcttctcagcttggaaggcttgcttgaaatcgcgggtaaccgtcactaacttaccgactaactcaccagcgcgccgttgaatctgactggtttgtgcttcgtcaaagacaaaataggttgttaaaagatcgttcagtgcccctttgacattatcgagggcgtttttgatccggtccttgtcatattgttcatcgggttctaatttcttagttcgtttggcgggtcccaattgggcgtcggtcaattgtgtgcgccactgcgcccaacttaaagtggccgcgttggcttgaatggcagttagtgctgcttgtgccgttgcaatagttggcaagtataccgcaaatttctcgtttgtttgacttagttcgttggcgagtgccaagtcttttaaacaggttgccaaggtcgcttctaactttggcagaatcgttgttttgaaataagcactggttgttaggccagtctctggtacctcgtaaggggcggttagagattgtaaccattcatcgggcgctggattggcaccagagaagttaaacagttcgaaaacaatgttggttagcccatcatcgttgcgatcgttcgaaaaattttgcgctaaatcataaaataaggcgtcgtttgactggtaatgttcttcgcgaacgcgttgccaaacttgatcctctaataagagacgttccgcagtatcacttaataaccgaaacgcgggatctaacttaatcacgtagtagaaatgtttaatgacttgtaagcaaaacgcatgcaacgtgctgatttgtgcggtcgggactaggctgagttgctgccgtaagcgttgttgcaccgctttgtcggttgcctcgcttgctttttttcgcagtgccgtttgaatccgttggcgcatttcagatgcggcggcttcggtaaacgtcaccaccaatagtgaatccacatcagtgccattcaagattttttgaatcacgcgttcaactaaaacggttgtcttcccggagcccgccgaggcagaaacgaggatatcatgccccgcgtgatcaacggctgcttgttgggttggtgtaaatcggcgatcactcatgtcgttcttcctccgagttcataattttggctaagacggcttgattatcaagcgcacttaattggcgataattattttctggtaacatcgcatcgaattggaaaatcgatttatatggcgacattgtgagtgcattcgtgcggtcgggccgcataatcggattcaaagcattttcgccagcaaaaatcgcttcccccgctgctttgattaattgatcgttatgggcaattaattgctgtaactcatcaagggtgaccagttgtttcgatttgaatgccccactctttggacgattgaagttaaacagtggtgaatagccactttctaaagctgtatccaagttttcgagtaaggtctcatcgtttaaaattaagccatcatacttaaattgatccagtaataattgatcgagttcgcctttttgtagttgagcgagtttttgtttgttcagttgcttcaatgacattgttgggttttgaaggtgcagataaaaggccccggctggttttaccttgctttgcgctggtaaaattgctgcttgatcttgcaagacagtttcaaggtatgtcaacatttgcaatgccaaaccatagtatgcatcgcggaagctaaagctgtgttgactggatttgtaatcaacaattcccaggtaggcttggtcgtttaatgtcagttgatcgatccggtcaattttcccccgcaccttaacccgacgttgattgggtaattcgaattctagaccagctaatccttgttgggcaccaacttggccgaataagacttcggttgccaacggttttaagttcgttcgttgactctgatcgcgcaatgtccggctgacgcgtttaattgtttgactcaattgttggcgaatgtagcccattcgcgctgatttattgaggatcttaaattctggttgttcatacgctttttgtaagatttcatccgtcaatgcatcgatttgttgattatcgagatcgggtaagactaagcgttgggcttgaatcatcttgataaattgatctaagacttggtggtagaaatcaccggtatttgcaggtgtcagttcaaaaattgggcgctcgttcagttttaagccgtattttaagaaataagcgtattgattttgatagaactcttctaatttcgagatcgacgtatggatttcattgccatataacccagtgacaatatcgcttgtcagtgcaacgggttggttatggtacgccagactttgaaggagttgattggttaagtagtgactaacaggaaattgttgtaataaacgataaacagtctgccattggtcaggaattagtgtttgcgtcgcttgtgcttgtcgcgcaacttgaatcaaatcgcttaacaaactacgccaagaacccgtaattggcgctgtacttgtcggaatgacttctgctagaacgcgttgctcggttaaatggaagtagtttttaatccggtcgacatagggggataccgtgtagttcgccccttccccattattcaatggataagtgaaatacaatccttcagtaccacttaaaaaggccaagtagttcagataaggttcaaagctcatctgactggcacttggatcagttaagaattgttctgaattgaaccgatcggttaatagttgccgatcatggtcggataataaggcgctggtttcaatctgatcaggcatcacttgatcggtcgcaccaatcataaaggtaattttgcggcgtttagtctgcaccatccctgattcagataaaacgacctggtcgagtgtcgatggaatttgcgcatattgcgccgtattaaacccggccgctagtaaatcccaaaagccctttagttcgaaaggttggtcgcctaataacgtcacatattcatccaacatcgtcataaatgtttgccatgtctgttccggttggccagctaaggcaatttgattggctgcgagtgcttggtcccgccaatttaacaattgtcgatcgacaccttgttcgattaagaattgatagagcactttagcggcatcgcgccctgttctggcactgtctaaccgtttataaaatggtggtaatacggattgaacataatgccgaatccgattgatccgttccgtgagcacttcatcttctgttgttcgaacaccatcttggaaggaaccgaaccgataatattgccaatcggctgcgcttaaccaatcatacccttcatacccactttttaaaatcagattttcacacaaatcaagatcagcccggaattcagcgactgattgatagtcatctggtattaaaagctccgtcttcaaaagcgccattacatcttcatagcggtagtaatgctctttcacatcaaacaacgctgccaacatcgcaacaagtggatgggccgccattgtttccggtaaatcgcagaagtacggcacttcgtattctgtaaaaatcggcgcaatcattgtttcataaggggctaaatgccgagtcataatcaagaagtctcggtagcgatagtggccggtttggactaaacgacgaatttcacgggcaacataccgtaattcggtataccgattttcggcaccgatcacttgaagttgcgtcgaatcgatttctggtgctgttgggatctgaccgtggttttcagaagcaacccagtaccgatcaagcgcgagtaacgttggtgaaacccgctggttagtggcaatctgatcagtcatgatgggaatgtgattttgcttggccagttggtataattgataatacgtacgctcagcttgataaaagaagctgagtttttccggtggttgttggtaattaacatagtcggtaattaagtctacggttaagcttgcttgctgcattaagacggcgactagcgcttgttcttgagccgtgaattgtgcgaaaccttcgatatagaaatgacaatcgtgtaagtcttgtttttttaaataatcagttaaggcatcaattaacgtcgtattttcgatgaattgcttttgcatagcggcttcaaacgccgtggcaataatggttatttcccgcaatttagtagtcagttcgacttcttcgggcgctagctgggccgcaatctcagttagctcatcgggtgtaatacagcccactttaagttccaatagttggctcgttaattgagcaacaaagcctgtttgattgacttccccaccaaataagctgagttcttctgcatgttcttgcaagaggcggtagacaaggatgtttaacccggcggttgaaatccgcggaatctggtagtacggggtatttttcatgaaataccaagctaatcgacttaatgagaagacttggacgcgtgaggttgcgacatactcacttccaggggtttttaggtcatttaaaagtgcgacttcagattcaaatttgatatgattcgggaccaaataaaaaaagcggtccgtgttggtggccttaaggtctgtttgtagttgcttgactagtgtttgatggtggtcataactagctgtaccaataataaattttaagctcatggcgcccacactcctttggcgtcattttaccatagatagacaagtgattgggataaaatccggctagtccgttggtaaaaagcgggtataataggaaacccattaacctgtgcccaatttgatttatgtggcggtcatttttgttttgcagtatagtagtaagggtatcttcaagtcagaaaaagagattaagggtgattgtatgcagactggtgttggccaaagtcatgcgaaaattattttaattggggaacacgctgtcgtttatggacaacctgcgattgccctccccatctttgcggttcaagcgcgggtaacggtaactttcgagccggcactccagacaccgcaaattaagagtacttattacaatggtcctctagaacaggctgttggtcagatgcaaggcattcgccggttaattgaacaactgtggcatgcattagatccgaacttaaccccgtttgaattgacgattgaaagtgacttaccgcccgaacgcgggatgggttcttcagccgcaacggccgtcgccatcattcgagcgttatttgcgacttatcatcaagagctcagtcaacaacggctgctaaagctagccgcgctctccgaaaatttaatccacggtaatccaagcgggattgacgccgcgacaaccgacgcaactacaccattatggtttgtcaaagggcagccgcttcaacccctacccattaatttaaaagggtatctcgtaatcgccgacagcggtcaaaaggggcaaacaggtgccgccgtcaaaagcgttcagaatcaaatgatgtccaatccagaacaaacgcaacccttaattgaccatttgggttatctaacgcaacaagtcgcaagaaatattgcccaaaacgaattaacggtacttggcgcgaacctcaaccgtgctcaacttgatttgcgggcactcggtgtcagcaatgcccgtgttgatcatttgattgatgtggctaatcagaccggtagtttgggcactaagttaacgggtggtggccgtggtggctgcattatcgccctggccgctacgcaaagtgctgcggatgatttggcacaagccttatcagcagctggtgccatcaaaacttggattcaaccactacacgcactttaaaaaaaattaggagtattactatgggacaatcaattacagccagagcacatacgaatattgcgctcattaagtattggggaaaacaaaatccggaattgattattccgtataacagtagtctttcaatgacgctagatcatttttatacagatacaacggtccgcttttcaactgatttgactgctgaccaaattagctttaatggtgccattgcggataccaaaactagtacgcagatgagtcagtttctcgatttaattcgaaaacaggcgcatctgcctttatttgctgctgtggaaaccattaatcatgtccccaatgctgctgggttggcctcttctgcttccggttatgcggcattagctgctgcgggtagtcgtgcagctgggcttgaacttaacgatcgggatctttcgagattagcccgccgtggttctggctctgcaacccgctcgatttatggtggttttgtggaatggcaacgtgggaccaatgatttggattcatacgctgttcccgttcaagaaacagttgattgggacatccagatgattgcgattgtcttaaatgatcgtcaaaaagccatcgccagtcgtgctgggatggcgaatacggtggccacgtcgccctactacccagcatgggttgaaaccgctcaagccgcaattccggcaatgaaggccgcaatcgttaagaaagatataaatttggtggggcaattagcagaacaaagtgcgatgcagatgcatgcgacaacccttagtgccgtcccacctttcacctattttgaacctgaaaccctacaagcaattaaagtcgtgcagaccttgcgccaacagggtgtttcttgctattatactatggatgctggtccaaacgtgaaagtgatttgtaccagtcaggaaacacctcagattttagcggcgcttgcgccctattttagtcctgaacaactccttgttgctaaaccaggtcctggtgtgagctatcgataatgcaaatttaagttaaacgtgaaaggttctgatggtttgataacggctaaagcgcccggaaagctgtatattgctggcgaatacgcagtagtagaaacaggttttccggctattatcgtggctttaaatcaatttgtgacagtcacaattgaagagagtcatgaatatgggagtattgtgtctaaacaataccaagaaaattccctttattggcaacgacaaggtgatgaaatggtttttgataaccgcgataatcccttccattatattttgtccgcgattcgcttaacggaacaatacgcacgtcaagcgggtaagacactgcgcgtctaccacctacgggtaaatagtgatttagactctgctgatggtaaaaaatacggtttaggcagttcagccgccgtaaccgttgcaacggtaaaagctctctgcgccttttatgaattatcactatcaaacgaccaattgtataaacttgctgctattgcgcatttagatgtgcagggcaacggttctttaggcgacattgctgctagtgtttttggtggctgggtcgcttatcggtcatttgataaacaatggcttgctgacattcgaccaactgttagtctaacggagctgctcgaaatgccatggcctagtctttcaatcgaattattaacaccgccagcagagttgtcactcttgattggttggacggggtcgcccgcttcaacctcgcacttggtggataaaattgcccttgctaaaacagaacggcaagccgattatcaaaacttcctcgcagctagcaaagcttgcttagaagcgatggtcgaagggtttcgtcgtaatgatttagcccagatccaagctgaattacgccacaatcgtgccattttacaagatctcgctcacttcagtcacgtcgctattgaaacgccaatattacagaaaatgggcgcattagccgagacaatcggcggtgctgccaaaacatctggtgctggcggtggtgattgtgggattgtcattattgatcgcgctatcgaaacagaggccctctttgaacaatggcgggccaatcaaattgaacgattgaaccttgcagttcacctcgtagattaggagcttacccatggtcagacccaaacaatccattcaatctcatcggaaagatgaacatgtctttttagcggaaaaattccgccatggtgatgccatcaatgactttgatggaattcggtttatccatcaaagcttacccgaaattgcggtatccgacgtggatatcagtaccgattttgccgggactaactgggccagtcccttttatatcaacggcatgaccggtggtagtcagcagacaaagaaaattaacgcacaattagcgcaagtcgcccaaattaccaacctaccaatggcaactggctcccaatcggtagccattaaagatccgtcactagcggatacatttagcgtgattcgcgaattcaatccccacgggtttgtactcgctaatattggtgctggtaatgatttgaatgtgtctaagcaagccgtcgcaatgacccaagccaatgccctagaaattcacgtcaacacgccacaagaaattgtcatgcctgaaggtgatcaagatttctactggttagacgagattgctaacattgtcgccaatgttggtgtgcccgttatcgtgaaagaagttggttttgggatgagtgctgatacgattgcgcaactcaagcaaatcggtgtacaattcatcgatgtttctggccgtggcgggaccaactttgtcacgatcgaaaacgaacggcgtcatgataaagcctacgattacttagctgattggggccaatcaacggtcgaatcgctctttgaatcacgcgctttccaaaatgacgtcaatatcctcgcttcaggtgggattcggaatcccctagatatcattaaagcacttcggcttggtgccagtgctgttggaatttccggtcaattcttgcacatggttttaaaagaaggcccgacacaaatggcggaaaacttgctcacttggcaagcgcagattcaagagattatggcaatgcttggcgcacgcgatattcaagcgctccaaaaggcgccaattattctctcgcctgaattacggcattatttgaatgaacggcacataacattttaagcagcaaaagcccggtagaaggatttcttctaccgggctttatttgattgcttaattagcaactacgactttgccaatcatttggttcgtttcgaccagttgatgcgcttgccgtaagttggctgctgaaattgggcttaagcactttgtcagggttgattgcaatttgttttgttccaataaggttgcaatctgtcctaagataatgccttgactcgctaaatccgttgtttgatagtaggtctttgagaaaacccactcccaagcgaactcgacccgttttttagttaatttttgtaaatcgaccgggcgatgattttcagtgattgaagcgatgcggccattgggcttaatcaggcgcgccatactctcccagtgttgatcgatgttattcaactctaatatataatcgaccgtttgatagccgagtgcgtgcacctgttcaatgagtgattgatgatggttaacgacttgatccgcaccatgggccagcgcccacttttgcgtttccggacgggaggcagtcgcaatcacgtgcaatccggccaaatgtgccagttgggtggcgatcgaaccaaccccacctgccccattaatgattaggatggtttgatcatgattagtggttcgatcttcaaaatcaatgtgtaatttctcaaataaagcttcccaagccgtcagcgctgtgagcggcatcgcggcagcttgcgcgtccgttaaattctgcggtgcttttgcgacgattcgttcatccactaattgatattcgctattactacctggtcgtttaaagtccccaacataaaagacacgatcacccggtttaaataacgtgacggcattgccaattcctgtgacaatcccaacagcgtcccagccagaatacggggcgttttgattgtcctctacccccttttcgaatgccaacatctacagggttaactgaaacagcggtcacttgtacgcataaatcgtgtggttttggtttgggactggggagattaaaagccattaaactttcttcatttgtaatcggtaaatgtttggtaaaaccaattgcttgcattaaaaatgccttctttcttattcaccattagtctaaaacattaattgccccgtaacaatcgtatatcgaatgtaactagttacattgttctcactaggcaaatgactgctagcggactataatggcggtatcaaaggaggccatttcatggttcaagaacggcacatttatgattgtcaggcgggctgcccggttgaaagcacgcttcaaattatctcgggtaaatggaaaagtgtgattatttatcaacttttgcaacattcaaatctccattttggtgatttgacgcgcgctttacccgattgttcgcgccgcatgttagccctacagctggaagaattaattgcggatcatgtgattactaaaacggtgattagtctccggccgttaaagactgaataccaactctctgaatttggtcaaatactgagtcccgtgattaacgcaatggcaacttggggaacttattataatcaggttgcacaacaggatgttggatactgtaatttgcagtaatgcctaaatttggatattcgctaaagcacttgacaaattaacttggataatgtaaaaatatagttgttaaaagtataagtaaactttgataatgaagtggtgcatattgaaagaaacgaattatgtcgaaaataaagtctatgaataccgagtactccaacatctttctcaagaaaaattaggtcaagcggttggtgtttccaagcaaaccatctatgcaatggaaaaaggcaactactcacctagtttgattttagcctttaagctcgcacgattttttgatgtaccaattgacgttctattcacttatcgggaggcgtaacaatatggccctactacactttttaaatcaaaatgcccatgtaatcgctggtgtggtaatcggattaatcatcatttcaattctgtttttctactatggtataactagaattggacgttcggatgaacgctcacagcttattatgtatcgcgtttttaaaacgatgtttgcagcgtgtttattatcgatgattttatttatgacttttgtgccagaccgcttaacagcagttcgagattggtttacaactctattcagtcttgtatttatcagtggcgcatgcgctgtttttattgaaccacggcgtaaagtttaacccttaaaaaaaaacggtttagtcaatctaatgactaaaccgtttttttaatgtgttgtttttcgtccttttggaattaaataataaaaggtaccgattaagatgagatcaatgatcatcaatccaataaaaatcgctgttcgacccgttaggtaaaagaaccaactaccaattgagaagccaatgattgagctaacaactaggtgcagcgcaaaaatttgggtttgtgccacgcggaatttacgatataaaccagtgctgagccctttttgtgcgtgataaccattgataacttggctaaataaataagtgaaaccgaccgcgatgatcatgaggacggcaattaccgcgattacacccgcattttgacggagccagttgacgccgactaacggcgtcgtcttcggtgttaaataactatgcttagtcgttttgaaaatcttttggtaagttttcagatgcgctcccatctgcggaccatcaaccaatacggtgactttattcagtgggcgatcatttaatacaaattctggtgacgtggatacaaaaatgtgctgatcaagcgtagttgtctgattcgtaccgacaacgccaatcacggataagtagcgaccatgatcttgataatacgcttgactagctggtttgtagagttcagcaagtcgtgattgaccagcaacgacgactggaatctgtgatttgaaatcgtaactggagaagaaccggccgtcttttaatgggacactcgataacttccctttcgcatagacatatgagaaccgggaatcaacgttgaattgaatttgaaaatggcttaatttcgcggcatcaattttttgaatggttttttgaatcgactgttgactcttagaattaaaaatcacagcattttctgataaactattgtgatttaagcgttggctatagttagtttttgcacgttggctaatcgttaacatgcctagaactgttaaaccaactagtaaacaatctaatattatttttttcaggcgcacagtgggccctcctttaaagcagactattgaatccagtaaaaccgatcacgcattaaatcgaatgggcgtaagtaacggttaatccgtgataaacgggcgtcgttgtgataatgggccgccgtccaaaaggcgtgactattcgtggcgccaaaacgttcgcctaagcacaacaaaacgggggcatttggcattgcacgaagttgttgcagcaattcataatcaactgggacaccgttgggtgaccaggacattaagattgcatcgacttgcggaccatatttttggaccgcttgtttggcgtcaagagctgccactgacgtgactaattggcgccctgtttcattctcggcagtccaggctaaactatcggtacaaatcacatcagcgcctgcctgccgtaaaccagcacttaaatagccgttaccagccatgacttctagaaaacgccaattgggaaactcgcggacaatcgccgccgtcaaatctgtagtgatataggcccacatgccaaagcgattttgcaaatattcacggtaattgcgcagtaagtggtcgattaactgtaactgacgttgaacctcagccacactagcggcgctaaaagccccctgttcagcctggagtaatatttctaaatacagagattcatcaattcccaaaacgggtaaattatgtatgggcaagccgtcctgttcaatctgcaataaactagttaaaactgcatgaatttgtacttgaatggctgggacggttgcaaaaaaacgttgactctggcgcaatttctctggataacttaactgtatcataatggattccgtttctaatataagtttctcttaaacgattagaaaaaccttcccaatcggaaggccaaatcgaacgttttaacgaatcccgagtgcaatgcgtgcataacgggacatcttgctggtatcccacgctgggtaccagacgagattgactttaacttcattgacttctggaattttgcccattgcttgatgaatcgaatccgttaaaacatcggttaagggacagcccatcgttgtaagggtcatatcaatcgtacataagccattttcatccaggtttaaaccgtaaaccaagccgagattcacaatgtcaatcccgagttctggatcaatcacggtctcgagcgcggctagaatccgttcctttaagtcttcaattgctgcatcatcttgtggttggtctgccatgtgtcctgcctcctggtcactctaatagctctattatactggttcaaccgaccagttacaactgacgatcattgacaacaatccgcataccccctagaataaaaagacatatcgtgttttaaccaaacacgtttttaaaaggaggcgccgctatgcatcaaaaattgattgcactggatttagatgggactaccctcaattcagatgcccaaattacacttaaaacgcaacaaactttaactgaattacaaaacgctggccacattgtcagtattgtcacagggcacccaaatcgtttgagtgaacctttctaccaacaattaggtttaacgtcgccaatggttaactttaatggggctttaatgcacattccgggacaagcctgggccggtgaatatcaatatacgattaataaagacattgtctttagtctcttccaactaaaagaacgctttaagattcaaatgattgccgccgaaggtaaaacgatgtttttagctgatcaagcttatgccaacacgttttctttcttccccacaacgttgaagtccgatgaaattttaacccgcgaatcgcttcggcaagacccagcggccgtcacggtttttgtggaacgcgctgatcaagatgcgttacgtgctgaaattctgcgccaattccctgacgtttccgtcaacacttggggtggtcctgctagcgtcttagaaattgtgcatcatgggattcacaaagcaaccggcctcgcaaaactagcggcacactacgacattgatcaatcagatatcattgcctttggtgatgaaagtaatgatttggatatgttagcctatgccggtaccggggttgcgatgcaaaacgcaattgcaccgatcaaggcgattgcagacgacatcacaccactgacgaatgcgcaagatggtgtggtcaattatttacggcaatattttaagatggattaatgaaaaagcgattcgacaatttctggtcgaatcgctttttttgatggatgaaacgtgcttttcaagctaactttctgtgcttagctacatccgtcaaatcaccgattttgtcggtaatctgcctgattaggctaatcctcagaagatacccggcttattgcacactctattctgaaacgtgctccgtcagatatacacttccggttagttacataccgcaaacgatcggctacgccgctcattcacggtattagactaatcctcagcgtatgaccatctgacgtcgcactctatttttcgtcgctctttagcacgccgcctactgagtagcggtctggttgcatttcgtttaggacaacgtgcacgtgttctgcaggtgcgcctgtgtttttagtgattgcttctgtgacgtctgcacagagttgttttaattgtgcttggctccggccagcgattaaatcgatgtgtactaatggcatgtgtggtgcctcctttaattgaatacttatattatgcctgttttaacgcaattgagcaacggtaattactgtgtttttaagcaaaagaatgtataataatagctaatattgatttatctatggaggcattacaatgagtgaacccctttaccgtcaattgacggcctgtaccagtgttttagttggtaagaaagccactgcagacggctcaactttaatcgcacgtaacgaagatagccaggcagcttggcctaaacatttaaccatccatccccatcaaaagttaacgactgccccgcactttgtctcaaaagacacgggtttttcaatcgatttaccacttgaagccgcaaaatacacggcgacacccgaatggaccgatgaatatggactattcgaagaagacggcattaacgaatacggcgttgcgatgagcggcaccgaaagtgcttatagcaacagtcgcgttctcggctttgacccctacatcgacaacgggattgctgaagaatccatgattacagtcgtcttaccctacgtgaaaacggcccgtgaaggtgttgcgcggctaggcgccatcgttagtgaatacggcaccactgaaagtaacgggattctcttttccgatgtcgatgaggtctggtatcttgaaatcggcagtggacatcactgggttgcccaacggattccggatgatagctatgccgtggttgccaatcaactcgcgattcaagaagtgcaattcgatcaaccggattggttcatgacttcagacgggattcaagattttgtgcgtgataatcacctatggcaagctgatacgccatttaacttccgcgatatctttgggaccaaagaccaaagcgaccttgtttacaacacaccgcgcgtttggtacggtcaaaaattgttaacgccatctgtcgcacaacaacctcaagactttaacctccccttcttacggcaagccgatgcgcccattcaagtcgaagatgtcgcgcgaattctaggctcgcattatgaaggcacggtctacgatccaatcggtcacggcacaccacaagaaaaacatgctttccgcccaattagtttagcaaagacgcaagaatcacacattctccaaatgcgccctaacttaccggtcgatgtcagcgggcttcactggttatcaatgggtatcacggcacaaagtgtctacgtgccattctatgcgggtgccaatgacgtcccagtcaattaccaaaaagggacaaaggattacagtcaagattcgatctactggacctataaattagctggtattttggtggatgcacactacgccaagttcgccaaggacttggaacaaacgcaaaaacacatcaatagcttaatggttcaaaatatcgtaacaaccgatcaagcggttgctgctgaaaccgatgcggtccaacgaacgatgttgatgaccaagggctctgcaaaagctgcgcaacttgcccaacacgaaatggaacgcctcaccgcaaaactgattacggatagcgcgaacctatcaccactcaactttacaacggatagtaatttatagataaaaatggtcccacatcgtattttgatgtgggaccattttatttactcagcaatcatctctctaatcttgtaagttccacttgcgtgtctaacttctacccgataaggatgtccatggacaactgatttagaaggagtaaatacatttccatttagggaaccatagtagttttggccattggtgacttctgccagatagctgttgtttcctaatacgactatcttataatgcttaaataattcgttagcaaaggtaacgacgattttattatttttaacactcatgtcagcaactaaagtgttcaagaacagttgctgtgcatggttaattctttgagtcaatatcgtcttttccgagcccttaactgcgttaatttgtgttcgtaattaatctaataggtcttgtgtgacctcaggtttcaactgatcgtttgtttcaaataacgcttcaacttgacgtttcagaagaagaatatcctgactaatcattttgagaatgtaagacttgtgcggtaattcagccactacggtaacaacatgtgcatccgcttggttaggaattgttaagacattatcgtcgagctgaccaccactactgataccatttttgacctctgcaactggttggtcgtcaacaagtaccttaattttcgcatagtctttaaacttctcatcagtaaacgataccactaatgctgattgtgaatccagttgaatatctttgactaatgtagctaggtatttgtcttctaattttgtaaatagttctaagagcctttctttatagtcaaaagtagaaggaagagcatcaattcgatttcggagagcatctagtttagcttgggttagaattgtaccaatcggttctgatgcattcaaatagtttaataactcttcttcaagtgcaatactatcaattgagtgttcatatcatttaaaagtaccatttttattttgctgggctcctatgtcaagaatccggacataaaagtacatggtgtttttaccatggcgccttttttgtgcaatcattgtaaccgctttaaatccatggcataatagagttatcaatgataagcgaggaataagatgatgcgcattgaacatgtcggtttatgggtccatgatttagaacaaatgaaagctttttatcaaacaatgttccaagcaacggctggggaattgtatgagaatcacaaaaaggggttccaatcctactttttaacctttgaggagggtgcacgatcagaaatcatgcatcaggatagtgaaatggatgggctggcagttaaagggcaatacgcacacttggcactacccgttggtagtgaagcgatggttgatgaattggtcgctaagtttcaagcacaaggcttacccttgttaaacggtccccgagtgactggcgatgggtattatgaagcggtggttcaagatccagaacaaaatttaattgaattaacggtttaagaccaataaaaaagtgattctcgattgagaatcacttttttattggattaagatttcagtcggtcaagctcgtcctttaaggctttgttttccttttgtttcttgcgataacgccagtaaacataaccaaggatgatcaggataagcagtacgccagctaatacatagtaccaatcattattttgcggtggtaagttcacatctttgctattccacttgtttgcagtttgtcttgaaatggtaaagttgcgagtgaaatgccaccgacgaccttcagaatgaacggttaagtcgagtgtgtaatgccccggttcgaaccgatcattgagtggtagatagaagggcatcaccgagttcggtgcgaattgaacatcttttttctcagtttaatagaacttctccttttgaccccgttttgtgacgaaagccttaatcgtcgtttagttttggaactttggttgtacgttgcgaatgttagcgcggatttggttactgcccatcatttgattggcttcaacctgaccaagcttgaattctggtgtcaccgaatgattattgttgcgcacgactaccgcaacggcataggcaaatttgttccgaatgttaatttgctggctcgttttttgatctttaggaatttcaacggcgctaatcccaccgacaagttggcccttgaacgcttttggcggtgtcttaagcgtcacgttgacaatccgttcttcattcgccttgagcgttattgttttagcttccggtttgagataattgcctagggcatactggacggtcttatcggagtgatcctgatgcgcaccgtagttcacaacgccgttcatgttcgtcgtggcagttttggccgttaagcctactttagtcggtgtgtcttgatgattgaccagtttcagctacaagcgaccaagttaattctgattggtagtgtactgcttctgttgggttcacagctccaggaactcgaaggttgatcgcatcttcgccaatgccagttcctaaagtggctttgatactcccgtaagctgttgcatcaccactcatgaaggtggcaggggctgtgttgaccgcaatttcagcggcaccgaagttggcaaccccagcactattggtttgagtaatggcacttgatccagttttgaagaccacttgagtaccagttaaaatatcagtaggatctgcgccgacaccaccagcagcgcccatgttcgtaaagtcggtttgtagaacttgtaaatcccagccgtctaacttagctttacttcggtcatcttgaacgctaaccacgttagttgtcgttaatgaccctttaccaacctgtgtactacttgccacaactggataatcgttgctctttgagcgatcgatttcgtgtgtaccgaaatgcatatctggaacggcggtaatttctaaaggattgcttttttaggtgaataatacggcagcatcagttttagcatcgactggagcggcacccgccattcctgctgataaaccagttgttgccaataatgtgagtaatgttgtgctaataagtgtctttttcataaaaagtcgcctctttcttaatgagtattgtgattaataggagcaataatccaagtagttgataaggtcgtacgggagcgacatcggtttgtgggagtcgcccaatcggttcggctggtaagctcgtaaggataatgtgtaatcccggctggccgatatctatgttttctggtgcggcgatgctagggggattgacgggcggctgagtgcttggtgtaaattgcactgaggccgtcgaattgacgggaccggcatccgcccgaatcggtgtaaagagtaggctgccaccgagtaacatggcgaaagagcacagttcatacatcgtaaaacacctcctggttgttagtatggggcggtcactaagatgaattctaattcagctgtgtaagggacatcagcgtctttcggacctgctgggaattgtgcttggagcgtcgatttgagtagatcagttaggttttcaacatcgggcgttgaagtaccaagagagtagcttgacttgctaaagagttgttggggcacgttgagttgcaacggtgttgtttgggcatctttagtccaaatgagtgcatcatttaaggttgatgctggcatattggccggggtcgcggtaaattgcttggtaaggttaacttggacagcccagtcgccgcgggtaccattgcggggatctgaaatcattaaatctgcatcggaagtgccatcgtatgaatagatcggactttgactgttagtcaatggcattgaggcaaattcgaaatgagttggtgctttgagaaaggccagttctggtggtggcaaatcttttagaattttgcgcgttggattggcgagggtgtatggtgctggataattagcttcaggcacaattttatgctgctcagttgggacgtcagcctgccattcatattgataagtttggttacttgcagcagttgccatagggccgtccaacaaggattgatccgctgcgtttaaaaaagcgccattcagttcactggcgggagttgctgtcccgtttaatttaaaggcgaattgttgtgcgtcatccgccgggagcccaccgatattatcgagcgtaatgatttcgggcggtagcggatcatgaacatggaattgtcctacggattttgtattactgaggctattcattttagcgctgtaggtgtcatccgtactattggtaatatcaccgtttccaatgatgctagtgaagtgaacaaagggaaagacggttttcgtttgattttttttcagtaacgctgacgcctcgataaatcgtgtgaggggattgactatctggattttcaaggttgagattaatgtgttcaaaaattcgtgtatcagtaactgtattattattgaacgttacatctgaatcaccaatgcttacgaggtggttgtctgattattgatagtcaccttgctatgatcgccaattttcatgtaagagccagtcgagcctaacggaatgagaccattggcagcgctttgggcaccattaattgttaagtcaacggtgctgttgtcgcggaaatcgtggaagaaaggtcgatcacttgaattcgcaaagtactgaccgaacgttgccgataattgaccgccaatatcgaatttcaagccactcgcttgggcatttcggataaaggcatcttttgcaactaagcccattttggaagtactgtcggctgtcagctgcatgaggggattaccagaggttggactatagatataagcgaagagatccttgccggcgttgagattaatctggctgccattggtagcactgattggactatcttgcacggaggaggcatcaaagacgttcgagtcggaagcgagattgatcgtactgttttgatctgctgtgactggactcttagtttgagaagcatcaaacgtcacgcccgttgttttaacatcaatactactattttgagtggcactcattggtgagttggtttgggcgagattgtagagtgtttcggctaactggaggttgatatgaccatcattggtggcgctaatcaagtgattagtcgtcccattttgatagaagttagtgcctttggtgacgttgatactaccgccgtcagaagcgactgttttagagccgacagtccccgtgacgtcaaaaatatgaccgccggcgtttagcgttaaactggaaccggctcccttagattcaatgtcgatttgtgtaatacccagaccaactgttgggaaaatggcgttgttggtggtgatgttgactttggcaccgcccgagacttgaagcccagcggcaattccatccgtgggcatttgttcaattcgaagcagaccgtaactcagtcggccagtgtgattgatggtagtcgtgccgcctctaaaatctaatcgcccagtttcagcaaattcttgggagtaagccgaatcttgttgcgtaattgtattgttcccgctaaaagcgacgacgccatacataagatgcagggcttgggcggtactagtgtaatcaacattatcgagtaaaagggtgctccctctggagtaactatctagcgcgggatgacagatgccataatagttattattcgttatttttaaattcgttagtttaattgttgtcccccccatgttactgccaaaatgaagacgaattgatgccgctgtggcactcgaatcaacgacgtctaaacggtggtgttgaccagtcagtgggtcagcaccgtcaatggtgatatcttgcgggtttgttttaccgagttgaatgcgttctgaattattactcaaagtaatgtccgctgtgagttggacgctttcgccgttttcaagggcggttttaagagcagcaaccgtgccaacctgggtgaagccggctcgagttgttgccatgggtttaggcagttcaatgacaggcggcgccgttgcctgcgttggtggctgaacgacttgttcggattctttagaactagcaatgatggaagaagattgttcgggctgactggtatcagttgcgtcaattgctagaacgtgatgcacatgtgctaataagaacgtcgtgccaccgataacagcaagacttttaaataaggtcttcataggcgccccctttatatatttcttataattatcataaccaattagttagataagagccgattaacgtggttgattagtttataaaatagaagtgtggcgcaataattaccagaataatcttgcaaataattacgtttgcaagcggatacataaacgttaaactatagatagcgtagagggattgaaacgaggagttgcgacaagcatgaataaacgagaacacgctatcattcaatatattttggcccagcaaaaaacgcactacgtcgatattgctgcacagctacaactttctgagcgcacaattgcaaccaccttggattacattgaagggatggttaagccctttaatgttaaactcgttcgaaaaccaaatgacggtatttattttacgggggatgttgcggcattaaccaatcatcttgaaaaagaagccaacgatcgtccgcaatcaaaggaagaacgccgtcattacattctggctaaattattattaggttcagaatcgattacgattcaacaactttccgatgccctttacgtgagtcggagtacggttgagaatgatttgaaaaaggtgaagcaagaactcgcgcaattcggccttcaattagcaatcgcgcacacaggtttatcattgattggttcagagcatcaaaaacggcaggcaaccgttgatttaattagtcaatactgggggaaaaggactgaagctgaagagttaaatggacagttagtgcggcatattcaattaccggataagctaaatcaattgtttgaaccgacgttgatcaaaaacgtactcgcagctttaacggaactcattgaaaaaagttctttatcatttactgattatgagtttcagtcgttggcaattcatttgatgatggcgctagaacgattggctcagcatcaattggtggcggcaacggagcccaatccagtagcgacaccgttgatttcagaaacaaagttgttagtagagattttagaacggcgatttgaattaacgattccggattttgagcagggatacctcaaccgtcatttagtaacggtccaatcgaaggatacatctgttcaaactatccagaccgagttgcggcaatcggtcgggctgccacaactattacggcaacagcttgctcaattagcagttgatgaggaattaattcaggggttggcggttcatttaagttcggcacttcgccggcttgcaatgggattgagtattaataacccatatactgatgaaattcgccagaattttccgcaagcctttgatcaagcagtgttactaaagccggtgcttgaaaatcagtatcagattcaaatgaatgaggacgaattagcctttattagtttacactttgaagctttttttgaacgacattcagaagatgcacgcttgagtgttgtcgtggtttgtagtagtggcattgggacatcgcaattattagggcaacggttggccaaaacgtttgctcaagaattgcggattactcgtattattgccttgggagaactacttgcaactccgattaaggaatcgctagttattagtacgattgcgattaaaggtttgtcagtgccggtgattgaagtcagtcctttgttaaatcggcatgatattggaatcattcgccagatgattactgaacaaccgacgcctaccaatcacttagtagctttattgcaacccgaactgacaattgtcacgcaagagcggttaacggatcaaggcgcaattgaattaattggtcagcggctcattgatcaagggtatgcaaagtcaacggttgtccaggcagcgctggcccgagaagctttagcaagtacggcacttggtcgagtagctttgccgcatgcggatccacaattaattaccaagccagccattgggttgctgattgcaccccaaagtattaattggcaacacaacgacaaagtgcagctcgtcttctttatggccttgaacgaaactgttcatggccaaatgcgggcgatttatcatgatttagaccaattgattgaaaccccccgtcttttaaagcaagtcgcacaagcatctgatgggacggctgccctcgccatcttggcacaattgaatcagaaaaattagaatggagtgttaccagatgaaagaatttgatgttgaaaatatttttacagatatcgttgttggggatgataaaccgacggcattagcaacactagcgcaattatttgctgataagaatgggttagatcgggttgcattaaccgcgggattcaatgcgcgtgaagctgagagcacaactggttttgggaatggggtggcgattccacacgcgaaagtggcgggattaactcaaccagttgtcggaattgtcacgtttgaaactggtgttgattgggaagcattagatgacgcaccagttgaaatcgcgattgccctaattatgccgctcgatgaccctaataagacgcatttaaaagtgttgtcgaagtttgcgcgcaagttgatggatgacgcttttattcataatttgaagcaaaatcggcatgatgcaatggcactctacacgttagttaacgatgaaatcgaatttaactaggaggatttagaagatgaaaaagtttgttgggattacaaaatgtccagttgggattgcccatacttatatggcagctgaaaaactgcaaaaagccgggcaagctcgcggatatgaagttaagattgaaacacaaggcgcttcaggggtagaggatgaattaagcgccgcagatgtggctgatgccgatttcgtgattattgccgctgacgttgccgttgatggggaagaacggtttaatggcaagccagtactatatgcgaagaccgctgaagctattaaagattctgatacactgattgaaaaagcactaacggcaggtatttatggcaagaatcagccgaaaacagaagctaaacaagaggacagtcatgaacaaagtccaattattaagcaattattaaatggggtttcccatatgattccgtttgtcgttgtcggtgggttgtttattgccttgtcaatcgcgattggtgggcatccgactaaagcaggaatggtgattccaccacataccatttggagtagtatgaatcagattgggacgattggttttaccttaatgattccaattctcgctggttatatcgcttatgctatttcggggcgtgcagctttagcacccgcaatgatcggtgcaatggtcgccaacaatacagacatccttggtacaaaagccgggactggatttattggtgcgattatcgttggttttgcggctggttacttggttaaatggtttaattcatggcccgtaccaaaagatttacggccagtgatgccaatttttgtcattccgttattaggggttgggattatctcagccgttttaattctcgttttaggcgcacctatttcatggttgatgacggcactacaagatatgttaacggccctttcacaaaatccagaaacgagtgtgattcttggcgttgtgattggtgcgatggtcgcgattgatatgggtggcccagttaataaagtggccttcttattcggggtggcatcgattacggctggacatccacaaatcatgggtgctgttgcttgtgccgttgctgttccaccattggcattggggattgcaacatttgttcgtcgcgatctttatacagaagaagaaaaatcagctgggattccagctatcttaatgggcttgattgggattactgaaggcgccattccatttgcaacagctaacccaaaacaagttttcccaagtatcattgctggttcagcagttgctagtgcagtcgggatggtcttcaaaatcaccgatgcagtgccacatggtggcccaatcgttggggtgttaggtgcaaccaataatattggtttgttcttcctctcaattttggcaggggttgctgttgcggtcgcaattttaaccacatttaaagtacgaaaagcacggaaagcttaatcttaaaagggcacacgagtaatcggcgctctttttttgtgggtaaaaaagttatgaacatgcgcttttttgaattatataaagcgctgtctatcgaattttgataaaaactggtataatagagccaattaaggtaaaaaggggtggcagtcgtgaaaaaaggagatcgccaagcacgaatcgaacaaatcattaatcagcaagttgtttcgacgcaagaggatttattagcaacgttgaaacaagatgggattgatgcaacgcaagcgaccatttcacgtgatattcgggagatgcaaatcgttaaggcacgggatgtgaacggtgagctccgctatacgatttttcacgatgacgaacgcacccaaactcagaaattaaaagataaactgcgtgaagtggctttgtccattacacaagtgcaaatgttaaacgtaattaagacgctcccaagtaacgggaatttattagcagccttaatcgatgatttggggtacccagaagttgtcgggacgctggcgggtcacgatacgattgttatcattagccctagtgaggaactagcagccgaattaaacgaacgtttcgcacaacatctagcaacagcgagataagcaaacaaataagacgttgcgacaaaagtaattttttgtcgcaacgccttattttgttgagctaaacatgttctgtgttaatcctcaggagatatccgcctgataactcactctttaatctacatactggttaaaaatgtctgggatgggggctgttactgttctttgttcatccgtgaagggctctgtgtagcgcaacgtttgcccgtggagtagtagacgctgtgttggatcggttggaaagtacaacggatcacccaaaatgggatgaccatcagccgccaggtgcaagcgaatttgatgtgttcgccctgtttcgaggttgactgccaaggttgctgcaggtccttttcgatgcagtaattggtaatgggtcactgcggataaacctgtgatgtaatcaatcgtgcgtttgcgcttattgtctggatcgacaccaattgggaggttaatcgttgcatgttccaagagtgtttgttccggatcgttagcaatagcgatgtattggcgcgacattgttttttgactaagctgtcggtttaaaatgccgatgacgattggggttttaccaatcaagagcacgccactggttgcttgatcgatgcggtggaccatgtaggcctttttatcttgtttagcaagataggccgccacttggttcattagggtgaagttttcaccaggaccgttcggatgggttttaatccccgccggtttattgacgaccagtaaatcatcatcttcgtataaaacggaaaaagattgccgttcatcaagttcgtagtcttggaccttaacggaaacttctgagaagttcatcgtaatttgatcgccagcttcaacgtgtcggttgaaggcgagataatgtccgttgaccaaaatatcttgattaatccgcaagaaatgttgcattttttgcggcactaaccagtgattcagcaggccgcggacagacatcggactaaagtcgggcgctaaagtcacttttttttggtaaattatcattagagttcaaccacctttaagctattagtttagcgaaaattggtgtaaaagtaaattttaaaagattgttaatgtcttcgattggcatcagtgtcaattgacgaatatgctacaattaaacaagattaattttgaccgtaagaagagggatcgcatgaacaagcaagcttcgccgttttggttggcgattaaacaatttatgaaacgcgtctggcgcgtgattcgttatgtctggtatcgactacaattgacgagatggctgattctcgctgttttaattctcattttcgcgatgagcagctggctcacgtttaaagcgaagacggctaacgtcggtgagattaaggccaacttacaaaccccaacggcgctttatgacattaaggatgaacgcgcggggacgttatattcgcaaaaagggacttatgtcgatcttgataagatatcgccgcagattcaaaatgctgttttgtcgactgaagatcggaccttttataccaatcatggattcagtattaaagggctagcacgagcagcagttgggttagtgattcatcatgggcagattaccggtggtgggagtacgattacccaacaactcgccaagaatgccaagttgagtcagaagcagacgttctcgcggaagtttgaggaattattcttagctgttcagattaccaaggtctattccaaacaggatatcttagcgatgtatttgaataatgcctacttcggtaacggggtgtggggcgttcaggatgcgtcaaaacggtattttggtaagaatgcgagtgaattagatgctagtgaaggcgccgtgattgcagcgatgttgcggagccctagtttctataatccggctgaccatttagataatgcgactgcgcggcggaacttaattctcggcttgatggtcgataataacaagttgacgcaagcacaagccgacgctgctaagaaagagcaacttgtcgtgacgaatacctacgagcagtcggatgggtatcgttatccgtattactttgatgaggttgtgaatgaagccattaaccgctttgggttgaaagaagaagacctcgttaagaacggatacaagatctatactgccctcgaccaatcccaacaaagtaagatggaaaccacctttaaacaaaattggttgttccctgataacgctgcggatgacaccttagttcaaggtagttcagttgcaattgatccgaaaaccggcggggtatcagccgtcgttggtggtcgtggtgagtatacaatccgtggttatagccgcattacacagatgaagcgtcaaccgggatcaaccatcaagccattggcggtttatacgccagccttagaagatggctaccactatgattcatcacttgaagataagaagcaaagctatgggactaaccactatacaccaacgaacccggataacgtttataccggatcgatgccaatgtatcaggcgctagccaacagtacaaatgcgccggcggtttggttattaaatcaaatcggcctcaaacgcggcattaagtcggtcgaaaaattcggcatttcagtacccaagagtgaccaaaacttggcgatggctctaggtggttggcaaggtggggtttcaccttaccaaatggccagtgcttatacggcttttgcgaataacggtgaattgtctgaaacacattttattcggaagattgttgatgcgagtggcgccgtgattgttgataataccgaaccatccaagacacggattatgagccaaaaaacagccaaagaaatgactagcatgatgttgggcgtttataataatgggactgggcgttatgcgaaacccaacggctatcaagtcgcagggaagtctggtagtactgaagtgcctgatagttatggctttgggaccaaagatcaatggttagtcggttatacgccggatattgttgttgcgacttggatggggtatgacaagacggatcaagatcactttatgaagaacactagcattgacggtttagcaccaatctttaaatatgagatgcaacaactcttaccaaccacagcacagacggactttgatactgaagatgctcaatcgttggcgaaaaaagaacagagtgggacatcgaacgaattagtcgattcaattgaatcgggttttaaagatgggataaataaagcgaaagatacagccaatcaatggtataataatttgaaaggttttttcaattaaatacatggaaaaaggagtcagtacaatgacagttaatatttatgatgatgccaaccaaatggcaacgcacttgcaagaattaccacaatttttaggcttacaaaatgcctttgcagcattgaaaaaagacgatattgccttcacaatgtttaagaaattccaaacgcaacaaatgacacttcaacaaaaacaaatgcaaggtcaagaattaacggacgacgaaattaaagaaatccaagaacttgctcaaaaaattggggacatcgacgcaatcaagaacttgatggaacaagaacgtcaattaagccaaacaatggatgaattaaaccaaatcatctcaaaaccaatcgcagatatctaccaagcatagaatgcgtttgaaacgggtttggctttgaggattaacctaaaaatgagactgatggcgtattttgtcatcagtcttattttgtagttaactggaaaagtcagtttcaaaaagcacgtttcaaataagagtgtgactgattgcggtcagcaactgagcattaatacaaaaatcgcgttaatccaggttctaggattaacgcgatttttaaattaagcggaagttgttgcaaccagaagcacgtttcaaacggtgaatcgattgatttcgattcaccgcttttttattgcctaaaaacagaacgtttgttctaatcgcctttatcacaccgcgtggcaatggtataatgaagcttatctaagctggttacgaccggccaaaagaatggggtttttcaagatgaaatttatccatgcagctgacgcccatatcgacagtccgtttgtcggattaaaacaagcaccgacagcattgtgggaaacaatccatgcgtcaactttcacggcgtttaaaaaattaattcagacagccatcgatgaagccgtcgattttgtattattagttggtgattcatttgatcaagaagcgcagagtttgccagttcagaaatttttaaaacaacaatttgaacgtttggcagatgtcgacattccggtctatctgagttacgggaatcatgattactgggatgccaatcaagtgcattttgaattgcccgccaatgtccatgtttttggagcacaagtagagtcgtttgaactgactaccaaaggacatgagagtgtgaccattgtagggttcagttatgatcaacggtggttgtcagctgatcgagtggttgattttccacaacgtgccagcacaacttacacgattgggacgttgcacggtagtcaaaaagcaacggccgatacagatcactacgcaccatttacgattagtgaattgagcgcttgccattacgattattgggcattaggtcacattcataagcgccagattctccaagaacgaccagcgattgtttacccggggaacttacaagggcggcataagaatgaacctggtgaaaaaggcttttatttagtggacaccaaagatggtcagttcgatttaacgttcaaaccaacgacggtcattgagtggcaacgtcaacagtttgaggtgacacctgacatgagcttaacgcaattgcaaacggctttgagtgcccaattgatgcaaagtgatcatgctagtttagtggcgctagagctaacacacgcggagcgattatcgagtgacttattgcaacggattaataatggtgaattattggcagtcttacaagaccaattggaaaatagtgaaccactgcattggccatacgcgttgaagttgcggtttgcagcacaacagcaatttagtcagattgaccaagcctactgggaccaagcggctgcagctatcttgacaccggacaatattctggaaaaagcaaagccgttaatgaaggaaaactttatccgggaagcaattgaaacaccagaatttcaagcggatctcaaggacttagtcacgacaattctacaagagaagaagatgggggattagccatgcgaattaagacagtcaccattttgggcttcggtaagtggcatgatcagacgattgatttgaataccgactatcaagtcctttatggtcaaaacgaggcggggaagacaacccttacagcctttattaaaggcgtgttattcggctttgcgaccgctaaacaacggtatgaacaatatgtgcccaaaaacggcgcgcaatacggtggtgaattactggttagctatcatgatcgcgatattgtgattcggcggctttccggtaagtttgggggcgacgtaacggtcatcgatcaaggccaagaatttggcgctgattacttagctgacctcttggcaccagcggatgaagctttgtttacgcagatttttgaaacgaaccaacaggatttaaatcagatatttaatctaaaacaggctgattttttgcagcatttattgacgattggtgcggtggggagtcatgagtggctcgactttgccaaggaactggataaggacagtcagaaaattttcaaaccctctgggcgtaagtggccattgaatgttgctttgaagaattatccagagttagtgcaatccgttaacgaagctagtcgtggttatcaagaatatgaaacgaacgcacgtctattgcagagtaccgttgcgacaatgacggaacaccaaaagcaagtggctgaattaaaacaacgccaagcgcagttgcaacatttgcttgatcgttggccaagttatgcggaatggcaagcacttcaaactaaacttgaaaaggcaacgccgtttgacttaacgattgacgaacaataccaagcattagtggtcgaacgagaacgcaatgcaaaggcgttagcagaagcaaaatccgaggtagcaactgttcaagaaacattggatcaaacaggtgaatttcgattttatcaagctaatcaagagacgttggtgccattgtttgaacaattaaatgaacagcaaaaacaaattcaattacttggattacggcaaaaccaaagcgcacaactcgctagcgaaaaagcccaattagtagcgcagtatcaatggcaaacggatcaactaccaaatccgttgacagacgagcaacgcgcacaactagaacaagccgaagctgaaatgaatggggcaaccacgaccagtcaagtgctgaccaagcaactggctgatttagaggcgcaattagccacgcaaaacgcggcagttagtcaggttgaaccacaagaaacgccaacgactgatggacgtgccagtcaattgagtatgctgattggcgtagtcatattcatgattggtcttttcttgccgggcgctctgaaagtcattgtggtcgttggactagccgcacttggctatggtggttacatgatgtggcaaaataaacaatctgaccatgaccaaccagtgcaaaaacaagcttggcaacaagcgctcgctaagttggatgtgttgcaggctgaaaagcaaaccaagacagctgccttacaagcacaacaagcaatattgcagacgatgcacgaacaaagcgcggtattattggcgcaaactggctacgaaacggcgatgccaatcagtcaagttttagcgatgcagcatgctttaagccagatgactcaattgaccatggcgctcaaacaacaacaagccgaaaatcaagcaatcgaagcggcactaaatatgtattgggatgcgtttgcttttgcccgtgattgggtgggggcgttacagggcagtcatgaagagaacttgtcccaggtgagccaattcaaagcccggattacccaactcacacaagaccttgcacaaagcaacgagagttaccggtattatcaacaacaagtgacacgcttaacagacacgattaaagaacaagacgctgcacaaacagcattactagcaaaggctaacttaacaaccgccgcagaattagccagttgtgttgctaatgagcaacagcgccgtgctaatgaacaacgtcaagctgatttaaaacgcgaattggcaacggacttgtcggctttacaagcaatcgctagtcaagaacagcttaagcaacaagccgctcaaattacagaacaagtggcaagtttgacaagtcagttacaagaacagcaacaagctgttgcgcaactacgcgtgacgcaagcgcaacttgtcgataatgacagttatcaacaacagcgacagcgacaattacaagaacaggctaagattactgatttagcccaagagtggctcgctaagcagttagcaattgattggattcaagcgacgctgaaggcagcttcacaagaacggttcccccgtttattggaaaaggcaacgcagtattttgcaattctaacccagaatcggtatattaagattaacttcgatgacacactgatgacggttttacgggcggatcaagtgctttttgaagtcggtgaattatcacaggggactgcagagcagttatacattgcgctacgctttgcgtttgcagaagaggtagctgacgtagtctcattacctttattggtggatgatggattcgtcaactttgatgatcaacgccaaatcgccgtttggacattactccaacgactcagtgcggccaaccaagtgatttatttaacggccaatccgcggacgcaagcacactttgaagcggatcattggttaaatctagaggaagtggggctgacacatgacagcaaagaaattatttgattaccaaaacgacgagaatctggatttatttgtactaattaaaacggcggacgtgcggattgctaaaaacggcaagcaattcatcgcgtttacgttccaagatcaatcgggacaaatcggcggtaaatactgggatgcttctgatgaagacgttgctaaatttacggcgggtcaggtgatccatttacaaggtaagcgggaattataccaaaataatccgcaagttaagatttataaactgcgcttaacgacgggggacgaaccgcaaacagttgaccagtttattcctaaagcaccggtgcaagtaaccgagatgcaagacgaatttggcgcgatgttattcgaaattacaaacccaaattggcaacgtttggttcgacatttaatgcaaaaacatcaagcggaattcttcagttttccagcggctaagaccaaccaccacgcgtttagtggcggcttggcctatcatacactttcaatgttgcgcttagctaagacgattgctgcccaatatccacaaattgatgaggcattgctatatgctggtgttatcttgcatgatttaggtaagacgctagaattgtccggtcctatttcaacggaatacacggttcgtggcaatttgatcggtcatattgtactggttgatgaagagatagtgcgggcttgtgatacattaaagatcgacgtgaatgctgaggatatgttgctattgcggcatgttatcttggcccatcatggtttaatggaatatggttcacctgtccggccacaagttcttgaagcagaagttctgcatcaaattgatgaattagatgcaagtatcacgatgatgacccagtcattacaacatgcggaagcaggtcagtttactgaacggctcttcgcaatggatgggcggcgtttctatcgcccagtcgaagatcctaatttagatcaaccaacagaataaatgtacaaaaagaaccccgctgcgactgcagcgggggtctttttgttaatgcttatttagatgatgattttgaagctttgctgttaacgccgtagcttgaaaggatgtctgataaatctttgtccttgatagatacgttagcgttcttaagcaccttagtgatgactttgttcatcactgtttggtctttaagccatgaagcgtaaacgatgtctgttaattctttcttgtgatcagccatcttacctttaccagggttcttgatcatccggataacgtggtaaccataagttgtcttaacaggggttgttgtatattcgtttgtctttaatttgaaagcagcagtcttgaatgttgagtcaagtgatgtatcagtactatcgaagacaggtaatttaccgccatctttctttgtaccagtatcagttgaatatttcttagctaattcgttgaagttctttgttgagttgtcttttgcaagtgcatcaatgacttcttgagctgtttctttcttttcaactaagatatgttgaacttggacttttggttcgtatgatttccactgtttcttcaagtcagcattggttacttttttgttatcttttagtgctgcttgtgttaagtattgtgttttgatgctgttcttaaatgatgtaggtgtcatactgctttgtgcaagcacagagttgaatgatgaaccgtattgttttttgtaaccatcataagttttcttaacttttttatcgatggcttttgagccgtattggttttcaagcgctttttgcaagatcatttgttgcaattgttgcttgccggcagatgtttccttgatttctttatagtattcgtcttgagtgattttaccaccctttaggcttgcgatagtcttgctaccacaacctgctagtgaaactaccattaataaactagcagcggctaatagccatttcttcattgtatgacacatccttatcaaaatatttatgaataaattcgtagtgaattcaccaattaatataacacataaactaactaaattgaacgaagcgtctaaaacttcacagaactttcaaatttaggttttacgctaaaaacgcgggaatcgttgacatgcttaaccttatcgcttgcatacaatctaatttttggtgaatttatttttttaagttttgtgtcaaacgatcaactgattcttcgatttgagcaattcgtggtgctgcttcaaatgaaaatgtttgcaatgcatcactgataccaccaagtgatgtaactgcagttgttttgagttcgtttgataaattttgcgaagctgtttgcaattgaacagcactttgttgaacatcagttgaactttctgagagctcgtttaaatagcgggcaatcgcttgttgtcgtttggggccggttgtagaagcggtgagaagggcataagccgtccctaataagccaccaactagtaatccttctgaaaatgacatgattagtcctccaattgtgcgtgaataccatctgcgatcgcttgtagttggtcagcagtgtaatcagcgctattatcaccgaattgcattgcaaatgaatcatccgctgtgtaacgtggaataagatgaatatgagaatgaaaaacggattgataagccaccgcaccgttattattgcagatgttcattccttggatggctggattgctagctttaatagccttagcaatctttggaatgcgactgaaaacggccgcagctaaatcagcatcgtattcaaagatgtccgccacgtgttttttgggtaccaacaaggtatggccgggtgtcacttgtgtgatgtccaagaaggctttgacatcgtcgtcttcatagaccactgtgttcggaatttcatttcgaacgattttgcaaaagatacaatcatccattaattatgcctactttctcttatttgaagtctcaatacagcttaatgctatcataaacaagggcttttcgctactgccatcagctttgtaagcggatggaaaaatattgagtgggggcatacactcgcagtttacttcgtgttaagatatgatatgaaaaaggattcactaaaaaagtagttttaaaaaccaaaaaacgaggctattgattatgagtttagagattaaccaattaacggggggctacgcgcacgtccccgttttaaaagaggtcagctttactgtgccaaacaatcaagtggttggtttaatcggtttaaatggggccggcaaatcaacaactattaaacacatcattggattattgacaccacaaaaaggcacaattactttagacggtgtgacgttacagtcgaatcctgaccaataccgccaaaaagtagcctatgtgccagaaacgcctgtcttataccctgaattgactttaaaggagcatttagaattaacaatgatggcttatgatttaaacgttgaagagacgtgggttaaagccaaagcattgttaaaacgattccgattagacaataagttagactggttcccggttcacttttcaaaagggatgcggcaaaaagtaatgatcgtcaatgcatttatgacgaatgctgacttgtttatcatcgatgaaccttttactggattggatccattggcaattcatgatttattagaaatcattgctgaaaaaaaagcacaaggagctgcaattctaatgtcgacccatattctcgcaacggcgcaacaatatgctgattcatttgtgcttttaaatcagggtcgcgtacgaacgactggcacgcttgaagaattaaagattgaatttaacatggctgacgccgatctcgacgatatttatctgcagatgacgaaagaaggttaaccatgcaagcattatggcaaaaacgcgtgcaaaaacatattcaagaacaagtgaagtatttgcgcctcgttttcaatgatcatttcgtgattgcgattatctttttattaggagcgttgggctacacatatgctaacgccgtcaaaggactggatccacaagcttggtggctaaaacctgtattgagtttagtattacttgcggcagttagttttggtcgcctagcaacattattaaaagaagcggatagtgtcttcttattgccaaaagaaagtggccttgtgacgtatttgaaatcagcacgtttatatagtagctggttaccattaattgcaatggcttttgtgacgcttctagtggcgccactcttgttaattactaagacggtcccggcatggcacatagccgttgccttgattacattggtaatcatcaaagaccgccgcttttcaatccagttgcgtcagtggtaccaagcggatgaaacccaggcaacaaaagggctttcgttaatcctcgatttggcaataattgccagtcaattatatcagtggctaaatttagtcggagtgcttgtagcgcttggactagcctattatcagcgacaacaattggcgcgtgttcaaaagacacagctattcgattggttagcggcagttggtgcagaagattcacgaatgggacgaatttaccgcctctataacctcttcacggatgtgccagggctcagtagtcaggttaagcgtcgtcgctatttagatggcttattaaagccaattacagctaaaccagccaatacttacctctatttatatgcgcgtggctttttgcggggcacagaattcagcgggttatatatccggttagttgttttagggggcatcattctgtgcttcagtcacatatggtggttgagtttggcactcggacttctattgatttatctagttggttttcaattattaccgttttacaatcagtatgatcaaattattttcactcatctatacccagtaccaacgaccaaacgaattcaagcgttcagccaattaatgcggactttattattgcttcaggcgttactctttagtgtcattttattagtgacactagggatgacgattcaagttggtttaagtgttttagcattgttcgtgctcgtgattggctttgttcaattctatttgcctaaacggttgggggcatagtccctgtgacacgcatgctttcctacttgacgactactggctaattattatatgatacccttagttattagacagttgaagcaacgtgagcgctgtattttggcgctttattttattgaagaggagtcgaggctgatgaattttgacctggatactggctggcaagttcgtccggccggtggtgatacgggcgctgcatttttaggcgttcgcgcgtcagaaaagattttcctaaagcgcaacacatcaccatttttagcggcgctctcggcagaaggaataacaccacgcttaatctggacgaagcggatttcgagtggggatgtcttaaccgcacaagagtggctcaacggccgaaccttgaaacgtgatgagatgaatagcccacaagtcgctaagttattagcacgggtgcatcaatcccaactattgaaacgaatgttacaaaaagttggcggtcgtgtctggtcagcaaacgaaatgttgcaagcctatttttacgacttaccgcaagatttacggcaacacccatttttagaacaaacagctgattatttgaagcaaacgttacgtcaattacaagcaccttctgcagaggtgtgccatggcgatttaagccataagaattggttgttatcggatattaatcgactctacttagtggattgggactcggcaatgttagccgaccctgcagtcgatttcggaatgattttatttcaatatgttccacgtcaagaatggcacgagtggcttgagaactacggcctagaggtgacgcctgaattaatgatgcgcgtcaactggtacggcagtttgaacctactccaaagtattaagcaccattatcaacgtggtcgttttactgaaatgaaccgtgacatattgcgcttagaagcagtgatttctgaaataattaataaaaattaaatgccaaaggttgggcaagtgtccaacctttttgattggcatcaacaaggagaacataatgcgtttaagaaataaaccttgggcggcggacttaattgcggccaaccccagcatgattttagtgagtccggaagatatcgccggcaagtggcaaacacgttttgccaaagaacaacccatttacatcgaagtgggttcaggtaaaggccaatttatcactcagatggcacaaaaatatccagaccggaactttatcgcagttgaaatccaagaatcagcgattgccgttattttacaaaaacaagttgaattgaaattgccaaatctccaattattattgggtaacggcgcagccttaacaactttctttgctgaaaacgaagtggcaggggtgtacttaaacttctctgatccatggcctaagacgcgccatgaaaagcgccgattgacatataagtcattcttagcggaataccaacaaattatgcaaccaacgggctacttacgttttaagactgataaccaaggtctattcgaatactcattgatgagcctgaatgattatgggatggtttttgacgacatctcactcgatttacacaatagtgaacttgcagaagacaacatccaaacggaatacgaagaaaaattcagcaagcgcggccaagtgatttacagattagaggcacactacaagtagagtgctttcaaagctggtcagcacccgagcaatagcctagtctggcaaataaccaatgcaattggttgtttgccggacgtagctatgcacacggtgctagctttgaaagcacgttttagataagagtgctcttgacgctcggtcagattttgagcactaacataggctggcgaatgagtgatgtaatcgctaatttgacaggtgtagttaggcgcagaaatctagcgtcaatagcacgtttcagcaagagtgtttttatcacacgggttgcctttgaggattagcctaagaaagggattgatgggggttctttaccaccgattcctttctgtagctaaccggaaaagacagtgtgataaagcacgtttcaactcaaaaaggtacgttatccagattttatctaggatagcgtacctttttaattataatattggttgaaacgtgctccgcgcggtatgttcctgcggttagcaacgtcagtcaagcgaccaataaattggtcactcgtctgactaagctaatcctcagaacgtgcccaccgcgctgcgcactctaaatttgtgagaattcaatcacgacgccggttcttgcgtctaccttgaatcgaaattggtttgtaccatcttcacgctcgcagatgatgccaccttgatagactggaaaggtccgtttgttttgtgagaataagtggggactttcttcaatccaagaacccacaatctggccttcatgttttaagccggctttaacatcttctaaaatttggtttaatttgatcattctttgttgcgcccgatattgcttcgcactggcagccgccgccagcgcaaaaccgatgccggttaataaatatttaaacgtttgcccattttttttcaaagaaaaactcctcagtcgtttttgtctttaaatagtatagcataatttttggtcctaaggagtggacatttacggacaaaccgcttatattaaaacgagtagtaaaattgaaggggtgcataatgaaagaattagcagcgatgacagatacgaatctgactcatctgattactgaagggaaacatgttttattttttacagcaacttggtgtagtgattgtcggtttattaaaccagccatgccagaaattgaagctgaattcccggaatacgactttattgaaatcgatcgggaccaatttatcgatatttgtgaagaatgggaaatctttgggattcctagctttgttgtgattgataacggtaaagaaatcggccgttttgtcaataaagatcggaaaacaaaacgcgaaattactggatttattcactcattgaactaaccttgaaggagtcattaaatgttaattgcaagtatgaaccaagcggcttttcccaacatcttagtggtaatgacccaacctgatgttgaaaagcaagtgacaactgaaaaacaatcaatcgtacggattagtgatcaggcaggtcaaaccatcggctataatttcttagcggtgaatgagttattgcccgatttacaattcaacggtgttcaaacactaactgaacagcaagttgctgttttaaatgaagcacttgtagcagctggtttcaccggtgatttagtggctgatgaaacaccacacattgtcgttggttatgtccaagaatgtgatgtgcatcctgattcagactatatgcacgttactcaaacacagattgcacctgatcaaaccgttcaaatcgtttgtggcgctgctaatatcgcacaaggacaaaaagtgattgtggcgacggtgggcgctgtcatgccagaaggtaaaattatctggcctggtcaactccgcggtgttcaaagtgacggcatgatctgtgcagcccgtgaaatcggggttgctggtgctcctgctaaagggattatggtcttgccagatgattgggaagtcggtcgtgaagtgacagcagatgcagtcgcagccctactaaaataatccatcttacgattttgttatgggattattaaaattaaaatagtataataatagatagcaattaattggttaaagacaaaccctttaattgttattttgttttgcagtcaattaagcagtaaaacacaaaagaggggttaaacatatgtgtgggattgtcggatttgctggtggattatttgatttaccaaagaaaaaagaagtattgaaccaacaaatggacgtcattaaacaccgtggaccaagtggtgatggtgattttatcgatgataaagtcgcattaggctttcggcgtttatcaatcattgatttagcaaagggtgatcaacccatttataatgaagaccacactaagctagtctttttcaatggtgaaatttataattatcgtgaaatgcggactgaattgatcgcacttggtcacgactttaaaacagattcagatactgaaaccattttgcatgcttacgaagaatggggtaaagaggttgttacaaaattgcgtgggatgtttgtctttgtcatctatgacttacaaactaagcaattatttggtgctcgtgatttcttcggcattaagcccctttattacacgactttagcagatgggactttcatgttcagtagtgaaattaaaactttcatgcgccatccagaatttaaaccagaactaaataagacagccttaaaatcattcatgatgaatcaatacaatgatttacaagaaacgttcttcaagggtgttttcagattcccagcaggccattatttcacttatcaagatggccaattggacatcgaaaaatattgggatatgtcatttaatccttcaaacttatctttcgaagaagaagtggctaagattgatgctgcagttgaagaatccgttaaagcccataatgtggctgacgtaccagttggggctttcttatcagaaggggtcgacagtagttatgtcacaagtattttgcaaccgcaagaagtcttcagtgttgggtttgatgatcaaacctataatgaagtcacagcagcccgggcgcttgccgatgaattaggcttgaacttcaatgaaaccaaagtgaatgccgatgatgcgtttgctgaatttgacaaaatccaatattacttggacgaaccagatgggaacccatcatgtgtgccattatggttcttgtcacgctttgcccgtgaaaaagtaacggttgccttatctggtgaaggggccgacgaattattcgctggctatgtcaactacggcatgcactcccacaattcaacaattaaggccttcacttctggcttgaagaaattacctaagggtgcgcgtgccagtttagccaaagccgttaagaagatgccagccttcccaggtcgcgtccatttatacacgaatttggcgaacccgcgtgaattctatacgggtcaatctgtgatttttgatatcgaaaatccaagtatttttggggcagatgaagccaatactttcttgaaacctgcttatcaaaatgatggaacgattcaagcaaactatcaagctgattttgataacgttgcggatgctgatccagtctcacaaatgcaatatatcgacttacatcacttcatgttaaacgatattttgcaaaaggctgataagatttcaatggcgcacagcttagaattacgcgtgccgttcctggatcctaaggtggctaaggccgctggtgaagtcccaactaaatacttaattaatagtcatgatacgaaatacgcttatcgtcaagcttctgctaaacatttgccaacagcttgggccaaccgtcctaagttaggtttcccagtgccaattaagcaatggttagaagatgacaagtattatgaaaaagtcaaagcactctttagcgaagatttcgttgcagaattctttgatcaagataagttattggccttgttagatgccaataaagaacaacgcattaacggccgtcggaagatctggaccatctttaccttcttaacatggtataaagtctacttccaaaatgtcgaagattatttagcattaggctagagtgtgacctatagaatccgtttaagtgcagccacaaaattaatttttgtggctgctttttttgcgttttagagatcaatcaattgataacagagaaaaataaacattcattatttagctcaaacccgcattatggtaaactataagggattagtttaatcatatagataattgtgatttattgaaaagaggacgtttaaaagatgataacaaatgacacagtttaccattttgttgggattaaaggttcaggaatgagtgctcttgcacttgttttaaacgacctaggctatcaagtacaaggctcagatatcgatcaatatacgtttacacaacgcgatttagaacgagcaggaatcaaaattctgccattctcagaaactaatttacacgaaggcttaacggtgattgccgggaatgctttccaagatgaccaaattgaaattaaaacggcccttgaaatgggcttgccagtcgttcgttatcaccaattcttaggtgaattattgaaaggccatacaagtatcggcgtggccggtgcgcatggtaaaacaagtacgagtggcttattagctcacgttttaagtggtgtggctaagacgagttacttagtcggtgacgggacaggtaaagggattaaagatgcgcaattcttcgcatttgaagcggatgaatatcgccgtcatttcctagcttattcaccagattatttaatcatgacgaatatcgactttgatcaccctgattattacacaggcttagatgatgtgtttgacgcgttccaatcagaagcttacaaagttcaaaaagggatttttgcttggggtgatgatcctgaattacggaaaatcaaagccaatgtgcccgtctattattatgggacacgcgaagacgatgacttccaagcccgcaacatccaacggacggtgcaaggttcagaattcgatgcttactatcatggcgaaaacatcggccattaccacgtcccactttacggtgaacacaatgtcttaaacagtttagccgtaattgctgtcagtcatttagaaaaaattgatggcaaagaagtggcacgcgaattggcagacttcaagggtgttaaacgccgctttacagaaaagaaagttgctgacgtgacaatcattgatgattatgcgcaccatccatcagaaattaaagccacattggatgcagcacggcaaaaatatccagacaaacaaattgtagcggttttccaaccccatacgttcacacggacaattgcgttaatggatgattttgccgctagcttaaaccttgcggatgaagtcttcttaacggatatctttagttcagtgcgtgaaaaagcagggaaggtttcaagtgctgacttaggtgcgaaaatcactaaaggtggccgcgtcttgaaattagacaacatgtcaccgctcttagacttcgaccaaccagtcgttgtcttcatgggcgctggtgatgtgcaaaaatacgaatatgcttacgaagaattattgagtaatttaagtcctaaagataattaagatttaggcattttgattgtctttctggatggatttgttacaatattcctaatcgggtgattatgggcccgtttagaaatataagaggtgaatattcatggaagaaagacgcgttgtgaatgtcgacagcgaagcccgctttttcagtaaagtgtatggtttgatggctgtcggtgtcggaatttcagcactgattgctgttttaatggtgactgtgtttaaagcacaaacttacacaatcctatcaagtggtagctcgtggatggtttggggcttgatgattgcagaattaattttagtcgttcagattagtcggcgttcaatgaagaatccaacggcctcgttagccatgtttgtggcatatgcggcgttgaacggattgacgtttacggccgttttactggtgtataacattggtgaaattggggcagctttcgcatcaagtgctttagtgttcattgccatgtcgatttatggtcgcatgacaaagaataacttaagcggctttggcaagtttgcaatgatggggttaatcggtgtgattattgtctcattggttaacttcttcatggcatcagctgcaattagctacttcttgtcatacgctatgttaattatttttatcattttaacagcatgggacaatcaaaagttaagtatgatgtaccgtcaatacggcgcaactggtgaaatttcggtttctggtttagctgttatgggcgcattaaccttgtacttagactttgttaacttattcctcacaatgctccaaatttttggcggcggcagagattaagggtttgataacagtcgggatatgactgttatcaaacgtttcaaaagaacggtcatcaggtaaaactgatgggcgttcttttttatgcttgacacaatactatgcataatatagtattaactttcgaaagggtgatcggtttgaatccacaattaaagaaaggcctcttggaattttgtgtgttagcaacgcttaagaaagaggattcatatggctaccaaattatcaaagatacatcgagtgtcgttgaaatttcggactcaacattatacccaatcttgaaacggctcgaggcgcagggtgaaattgaaagttatcgggtcgaacataatggacgcttgcgtaaatatttccatttaacattggcgggacaagcatcgattgatagttttttggccgattggccggcagtgatgggcatttatacttacataagggagtgtaacaatgactaagaatcaatttattaaacagcttgcggcagaattaacgcggtatgggattagtgatgcagccaacacgattgattattacgatgaattaatcgatgatcgactggaagcgggtgaaacggaagcggagattatcgcgagtttagcaacgccagctcagattgtagcgcaattagctacaccagataaaccggttcgccaaaagaagatggcaccgatgttgattattttaatcagtatcttgttagtcttagggtcaccgttatggggcacgttgttattgaccgccatcatattagtggcacttggttatttcttgatttggttaggcccgtttctgggggcaatctttgctgctgccggcattcttggtgggagtgtcagcttagttttatcgttctttgttggcttacaagaaggctggataattgcggtgatgcagcttggaattagttttgtgatggttggtgtggggctgatttgtgcaggggcgacctggtacatgacgaaatacttaattcgtttctcggttggaatcacacgctggctagttgggatgttccgtagtcgattaaaggtggtggcgtagatgttgaaaaattggttgaagattagtttatgtatgattcttgtgggaattattttaatgaccgttagttttgggatggcgggttttaaaagccaaccattccaatatcgtggcacacatgaatggagccggacgtttaacttttaagataggcaaattacagttgaaagtttaattcgaacatttaaattaaagaaactaccgcgagaacaagaatacttatcattcttacaagcaactctggcaaatctcactgaaaatgtacatgctggttattttggtgaagatcgtgggactggggatgaagctgttcaagccgaagttgatgatattttaaaaaacaaggaaaagttactttcctttaaagatgataaaggaaaatggcaaactagacgttttctattctccaagtggacattacgagaaggttgggataatcccaatgtgtttgtgattgctaagttacggacgtcagggagtgaaaattctaagattcaggaagttggtcgggggttacgattacctgtcgatgaaaatggacatcgtctacaacagacggaattacctagcagattaagatttttaattggttatgatgaaaagtcatttgcagaaagtttagtgagcgaagtcaatgatgatacaactatcaaattagatgaaaccaaaataacagataatatgatagaaataattttaaaagatgatgctagtcttacaaaagatcagcttctagaaaaattagatatcgaaggaattattaaccgcagtaatgagtttaaagaaaatggtttaaataaactactagatctatatccagttttaggacaacaaagtcgcgttagacaagataaaattacggtgggtggacctagatctaagcaacgaattaagttgaataaagataactggaatcaaatgcgtgaattatgggagcggttctctaatcgatacatgctagagtttacgcgtattgatgaggatgccctacaattcttaattgatgatgttatgcatgaagaagatatatttgtgaagcaatatgctgaatcagttcatcagaccctggcttatagtgagaagaataatgaaatgcagataaatgagcaaacagcagagtatgaaaaattaaatgtactaaatgggatgaagtacggtgaatttttgaagatacttgttaaagagacgaatctaaagccagctcaattgcatagaggtttatatactgttttaaaagataaattaaattccaatactgactatctaaatgagaagactttgaataatttaaaacgtgcgtttacacagcattttgaaaatagttatgcacagagttatcagtatagtgcactagattttcaagcaagcacgtccgtatttgatgctaagtcaaatgattttaaagaagatgttttagcgtcagtaattggtgtaaatgaagatgataacgtagcagataatagacgccagctttatgagttaccgccattgaggtatgattctgtgaatcctgaaagagaacttttacgaagagattatggtgcaaacgttatttcttttggaaagttacctaaaaaagctattcaaatacctaaatatactggaggttcaacaacaccagattttgtttatattgtcgaaaagcctgataatacaaaggtttatttattagttgaaactaaagcggaaggttctgggaaaagaattagtgatacgcaaattatggctattcagaaagaattctttgggcagttaaaagaaaacggtgtggcatataaagtggcgacaacagctgaggatgtttttactaaattaagaggaataagtaaatgatagataatttaatgactttagtcgaaaatagtgaaatagctagtacgggagcaaaacctaaattaccaacaaccattcccaatttaacagataaaatgttagaagtttatcgaataccactcaaatatctttattataatgacgagaatggacggattgcgactcaaattagacggtcatcagaagatatacaggcatgtagtgatgcagtatctgccaaatataacgatcaagttgctaaatttattgaagaagataatttagctgccctcaataagaccaaaaaatcaattcagtcaaagggtcagcaagtgtacggatacgtcttaaaagatggtcgaattattgatggcaatcgacgattcacagcattgagacaactgaccaaagagacgggacggactttttattttgaagcggttattttaccatttacctatgatgcaaaagctgatcgggctcaaatcaaacgattagaattagcaattcaaatgggtaccgaagaaaaactgcaatatgatcccgtagatttatcgattgatgtttatcagactgttgtaaaagatgagttgatgaccgaaaaagattatgctttggaagcaaatatgactaccaaagaagttgaaaatttaattgctacagtggaattaatacacgattttttaaagttcatcaattcatctgtaacaaactatcatattattaaggatgttaaattgtatacacctctattcgaactagcgaagaaatttaagactgtgtttcctgataaagggcctaagtatgaacaaactaaagagtcctcatttacgctactaagtaagatggttttagctggtggagatacaggccgaaatatgcgggattatttaaaagaagttgttaattcacaagttaatgatacgtataatcatgatatcgaagaagttgttgatgattttcgggataaattggatcaaaaaccaattgagactgctgcggattatcggaaacgattagcagaggcaacaccagagatgcgtgaggtgtcggaggtatacaattcaactattagtcgtcaaaacagaggtaaaaatgttgataattttatctcagaagttaaagaaacgatggtgacgcttcaagatatgcaacgcggtggcggattatctggtaatttacattttagtaattttagtaaaaagcaaattgccgagattcgtgagatgctagtgaatataaacattatcagtggtgatttaattgaagaatatgaaaatgaactctaagatacagctgatacatgaggatggacagtttagatttgtggacaacgaagaacaggatttacgttcacgcaaggtgaagcgagtatttgaccgatatcaagcgtattttaatgatattgatcgtatggttttatcaactggcttaacttatgttgagcttaatgaattaatcgataaggtgaatactaaaattgattccttcgttgaactagacgaagaagtacgaggttttatttcccaatccagatatgccattcaggaacaacagatagccggagtaacaatcaagaattatgatgatcggtggacaaaagaaattaatcgatttgaaatgattgttaatcaagagataagtcggccgttaaaggaacaacaagttcaagccagcttctatatggctatgatgaaaaaggcagctaattttagtgtccctggtgcggggaaaacagcgatgatgtacggcgcgtttgcttatttaagttctcctgagttatgtgaagttaatcgattattagttatttcaccactaaatgcttttgaagcatggcgttctgagtttatcgaagtgtttggagaaaaaagacaattaaatttcatgaatgtaaagaaatatgataatcctggtgatttgagaacggactgggggatggcaaatgttatcgtattaaattacgaagctttatcaggatggaaattaaacacactaaatagtttaattgatgagcatacgatgattgtttttgatgaggtgcatagaattaaaaatcctgaaggtaagtgggcaagaaatgcactaacacttggtaaacaggcacgatatcattatgtattgacggggacgccgatacctaattcatataaagatatttataattttttgcacttactctatggtaccgagtataatagctttttcggttggagcgtatcagatttagatgaatcaagagcgttagagataaatgagaaattacaaccatttttttggagaaccaataaagaggatctaaatgtaccagctgcagatcctgaccaaattataaaagtgaatccaagccatgatcaaaaaatgatagttgatactatttactcagtagaaacaaatgttttgggaaagtacattcgtttacttcaagcttcaacgtatccaccactattgacagagaaaataaatgttaaagagttgggttttttaaaaggtgaaatagattttaacgttgaatcatcttttaattcgttcgaaaaagacggtgctaagaagaacgcgtatttgaatttgaacgttgagaacatcaagacgcctaaatttaaaaaaggaattgaattaattcaacagctcgtttcagagggaaagaaggtattagtttgggggatgtttgttggcacaatgaaagcaatacaaagagaattgcagtccaatgatatttcaacacatcttatctacggagagacaccaaaggaaaacagagttgacttaattaatgattttcgaaatggtaatgcccaggtattaatttctaacccagctactttgggagaatcgatttcacttcatcaaacggtacatgatgctgtatattttgaatacaactttaatttaaccttcatgctgcagtctagagatcgtattcatcgtctaggtttaccgagcaatcagtatacacgatactattacttgatgactgatggtgatagcgctcatcaaagttttatagatagtcaggtctataagcgtttgaaggaaaaagagttagtaatgatgcatgctgttgaaggagactatctacttccagaagtttctgataattatttagaagatataaaacagatattagtgaattaactacggttaaaaagccaccagtattgagcttcaaatttagcttatactgatggcttttttagtttaattttaatgcctttcatggtgaaggtgcttttgcgagacatttggagacccgccttgttaataattctctacatagattatagattgtgtgctgaaatacataatgtagtaactggagataaattgtaatttcaaaaaattaataaataatgaattgacttacgatcgatataaacgtaaggtttttacggttttttaaaacgattatttcatattttcaatctatgctaaaataatcataaataaaaatttgaagtgaaggtgccgggtatcgttaatactgatgaaaatgtgagtcaatttaagtggttattacgtcgctttgtcgaacaagcgaatttgaatattcagtcaaaagaaggacgcagtacgacagtgggcgcatctgggtttgaaaagaatcgatttagacataccggtaattttgatgagttggaaatcgataatattcattatatgatccatctttttaattcgggatcatatggaccacttagcggtgaaggcgatagtaagttgccatatttgaattatgatttggcggtaggtaagagtgttaatatccgtgcaagtttcagacagcagaaaattgaaacgttacgaattattgtgcatcaagatcaacacgatactgaattaaatgaagcataccaagtggacgatttagatttattttcgaaagatatacccaatcagaaacttactcatttttatgcaacatttacaaactatccagtacggaatggggacaatgatgtgttaggtaatttagaggaaaaactgaaagaatctaaaaatattattctacggggcgcccctggaacggggaaatcatatcttgctaagggcattgctgcgagtttaattagtaatggttctgttcaaaaatacgctgacttaaccttagaacagaagcaacaagttggttttgttcaatttcacccaagttatgattacactgattttgttgaaggccttcgtccggttactactgatgatggggaaatgggatttgaattacaaaacggagtatttaaagagttcgtaatgaacgcaagaaaggctcaaaaaggcggtgctgataattttaaattagtttgggaacaactcattttaaaattagaggaggtcggttatttaaatattccgaatactcgaagtggttactttcaaattgagctgaatgaacaaggaaatggtctaacgacaagaacctacccaggcgagtacggggttggtaattggattcaagggaagagtcgcttttataataaaacgcagctttacaatatttatcaaggtaaaccgggtgtcgaaaagggcggtcatgataattatcgaaaggcaattgtccaatatatgaaagataatttggggctaaaagagtatgttgaagttcaactgacggcacctaaaccctatgttttcattattgatgaaatcaaccgcggtgaaatctctaaaatatttggtgaactattcttctcaattgatccgggctatcgtggtgaagaaggggcagtttcgacgcaatataccaatttacatgatgatccgatggagaagttttatattccggagaatgtttatattattggaacaatgaatgatattgatcgatcggttgatagttttgattttgcgatgcgccgtcgattccgctttattgaagttaaggctaatgaacatattgggatgttggcagctttaggggataagcaaaccgaagcgaccaaccgcatgtttgcattaaatcaggcaattattgatgtggacgagttgaatgaaaattatcaaattggtgcagcatactttctaaaactagcaacagtttccttcgaacaattgtggtcagattatttggaaccgttgttacaggactatgtacgtggactctatgatgaggtgaaatatatgactaactttaagagagcgtatgataatcctaataaaatggcaggattgaataatgatgctgaaaacgactagggataatcaacgtgaattaaaagaacactataaggatatccctaaacttacaaataaattagttaatcaaacgctaacgcaactaaagaatgatcacctttttatttttccagaaataattgccaatgccgacgatcttactgccgatcaaatggttcttcgaagtattaatgaggattatcaaaccagtaatttagctggttttattggttatcaagatgagaggctgattattcagtctcgttttgaaagatcggcgaacaattatttttttcagtatctaattgagcgggtgtttgatatgcctaacttgatggcgttaaatacggaggcacagcgggatagattggggtttgacttattggcttttttattgccactttatttaaaaaaagcgctacgcaaaggcctttttaaaacttatggtcggcgtcaatataatgacagtaatatacgtggaacaattgatgtggcacgtcatattaggcaaaatagcccatttattggaaatattgcttataatcaacgtgaattttcatatgagaatgaagtaacattgctaattcgccatacgattgaatttatcagaaataaatcgtacgggaaggctgtgttaggcaagatatctgatgaggtagctacaatagttgttgcaacaaaacattatgaagattatgatcgtcgaacgattatcactaaaaataaagaaaatccgattcgacatgcttattatagagaatatcgaagtttacaacggttgtgtttaatgattttgcagtttgaaaaacaacgaattggtggcggcagtcaacaagtacaaggtattctatttgactgtgcgtggctctgggaagagtatattaatcaattgattggaccgtggttttatcacccaatgaataaaagtcgtgtgggtggacaatacttattcgaccgaggcggattaatctatcctgattttatcagtcgcgtccaagaacagcgtattattgctgatgcaaagtataagccacaaggaaatatcggtaaccaggattatttgcagttagttgcatatatggcacgctttgatgctcaacaaggctattacatctatcctaatcatacggacgaactcgttacgccattgcatctgagacaaggagtaacctatgaggataatgtatcagtccgtgaatcggtgatgattgcaaaattaggtttgaagattcctgaggtacgggccgaaacagatgatgctgtaggttatcaagcgtttaaagaagcaatgaagaagagtgaagaaaacttcctaacgtcttttttgaagtaatatgatatgtaatgctttaaactatggagctataaatttgaattcgcaagtcatggttattttggcccgcatgaagtatatagtctcgatttagaaactggtttgatgattggcagaatggtaacgcatgaatttattcatcctgaagaggttaggtttcaattggatgtagatactatccgtcgggttcgtaatcgactttcaagattgcaacttccgaagtgggctgactattatattaacgagtctatcattgatggtgagcaatggtcagtaaccgcgacctatgcagacggaacagtgattgagtctggtggctctaatgattatccgcctcgctttgggacagttagaaatttgtttaaaccagttcaacaacagtttttaaaagattagatgtgtaatgaataaagccttagggattagtttttcaagctaatccctaaggctttatttttatgagtgctttagttattctcgtagtatcttctccatcgtcttccccttagccagttcatccaccaacttatccagccagcgaattttttgcatcagtgggtcttcaatggcttcaacgcggacgccgcaaaccacgccggtaattagattacaattgggattgatctgtggtgcttcctcgaagaacgtttggtaggggatgtctttagcgagttgggcgtcgagttcgctttgtgagtagccggttagccagcagataatctgattgacttcggcttgggtgcggtttttgcgttcggctttttggacgagcatggggtagattttggaaagagacatgttgaagatgctttgtctgggcatgagaaggcctccttggcagtttagataattaatatatagcatgtaatgaaaatgaatacaaaatttaggtctgagaaagagtgaagttatttttcactctttttcttttgccctatttcttttccgttactttcttgttataatcgataccagttgtccgtgttataatacagcggactaaatgttataacagaggagagtacagatgagtattggcgatattttaacgaagacgtttacgaacatggatattgtgagttcgatcacgtcgacagtgtttattattttattaggattctactgccgcaaacgcgagatcttcacggataaatttgggaagattctgtcaaaagtcgttttaacggttgctttaccagcactagcattcaactcattcatgcaagatattaatgggaagactttaaaagaaggtatcaacgttttagtttggggcttcttgatctatattattttaattttaatttcaaaaccgttatacttacgttttaagggtgatcaacaagacacattacgcgtgttgaccatctttggttcaacaacgttcttcgggattccaattgttggggcagttttcggagctaaaggggttatgtatagctcaattttcaacattggttatcgcgtgttcttatactcatatgggtacatcaagatgagtggcttgaagatggaatcgaagaacttgaaaaacatgttcttaaatccaatcgtgatcgccacatttgcggggttaatcatctggttaatccaaggcgcattaccacaagtggcggttgctgggcattcagttgctttcttacggattgatcaaacagcgccatggttgttcaaaccaatgacgtacttagctggtttatgttcaccattagcttggttagcaattgggacaacgcttggcgaaatcagtttcaaagaagctgcttcggacaagacatcatggatttatagtattaacaaagtgattttagtacctgctttaaacatcgtgttattggccatcttaacaatgacccacattttaccagttagctatatcagtttggcaacgattgtcatcatgatggcaacgccaacggcaacggtcgccgctgcttacgcgattagttttgacaaggatgcggtcttagcatcgaacgcgtcattactatcaacggtcttagctgttgtgatgacgccagtctggttagtgattttagaagtgattaaccaaatcgggattttctaggaagagggaaattaaatgtttaaaattgcttgttacggcgttcgtccgaatgaagtggcgacgttcaataaatataacaactacgattatgatttaacgttaattgaagacttattgactcacgacaatatcgaaacggctaaggggcatgacgcggtcttgttacgtgccaactgtaccgctgatgcgcaaaacttagcgaagttgaatgaatacgggattcgttacgtgtttacccggacagtcggttacggtcatatcgatttggccgcagcaggcaagtacaacatggaagttgctcgcgtgccagcctactcgccaaacgcgattgctgaattggcattgacgctagggatgtcattgttgcggcacaccacttatacaacgaatcggacagcccatcatgatttccgtgtgagccctgtgatgttcagtaaagaagtccgcaactgtacggttgggattatcgggactggcaagattggctacaccgaagcgaagttatacaaaggcttaggtgccaaggttgtgggttacgacttatatccatcagaaatcgccaaggaagtgcttgattttgtcagcttggatgaattattggcccaaagtgacattgtcagcttgcacattccgtacttcgctggtcaaaacgaccaattcatcaatgcggacttaatcgcaaagatgaagaacgatgcaatcttggtgaatacagcccgcggacaattgcaagataaccgtgcgattatcgatgctttgaaagctgatcaacttggtgcattcgccgctgacgtgttaccagctgaaggcgaaatcttcttcaagcaattcccagcagatcaacctgtgccagatgcaaccacccaagaattgattgatttatacccccgtgtcttgttgacgccacacgttggttcaaatactgacgaagcgctcaagaacatggtcgagattagttttgaaaacttccatgaaatcttgacgacgggtaagacgcaaaatagcgtcgcaaccactgaaaattaaggaagtttgtcaaatggtgttgaaggatagtttctatcctttggagatctcctcgtgtgggagatcttttttgttgttttattagttgcggcgtttaatctggtgtgttgtctgaatatcgtacttgaaggcataacaaataagcctaccatcgtgacgttattgtggtagataatctaggcaatcagctgggtagatgcgtgtgaacatattggcctgattggagaagccataacaagcacgtttgagctccttgattttacggttgatgccctctatcggtccgttagagtaggacgatttggcggcgttaattactccattaagattctttcgtagggtatgcatggccgtatctaggggcgtgccgttaggctgatagttagtgatgatattcttgagttcatcagcgtgacgccccatcaaagcatcgtggagatcgatgtaggtttcataagctgttttgaaggccggaaacgtattggttccaatatcaatagcgttctgttcggtcgagtactcattcaggccgaagaggtagcggctcttttgtgcgtcagggttggccttgtggaataggcgccatagtgatttcagtactttatattcccgcgaatgcttgtcgagttgctttaaacattgagtgcgaatggtatccatcgtccggcccattaattgaataatgtggaaccgatcaataatgagttcggcgttagggaatagttcgtgcacgaatgcctgataggaggcgttcatgtccatgatgacgcgttgaaccgcggcccgttctgcggtgctgtactgactaagaaagaactgtttgatggttctattaaggcggtcgctaagtactttaactgatttgtgagtgtcggcgtcaatgcaaataaacgacatggagccgtgcgtgggacggaattcatcaaagcatagattaatcggtaaccggcggctcgcgtgtggatgaatattagccgtcaaaatacgctgaactgagtttgtcgaaataccggtgagactggcgatagtcttagccgggagtgatttactggctagcttcagcacatgagtcgctagtccgtgaccgatggcgtggttggttgataccactggagtggcggccgtacgagtgctatggcagttactacaacgccagcgttgcttgtttagctctagaattacgggccggtccatgggtcctgcaatgtggacatgagtgagcttgtgtccgttagggtgcaacgtattgtatccacagctgggacagcgcctgagtgtgtaggtaagctctgcctggatgaccaaatactttttgcgacccgagccccgaccatgaaattcctcacgagtaccgaacacctgaatgtttgtgtctgtaattcccagtaatttaagtgtattatctagttgagacatctattcctaccccgcttatcttgagtttcgtcgcttaaagcatagcactagggaggcttagatgcctttttttgttatcaaaaagggcctagtacttttggaatggaaatactttccaacaccaaaaattctagacccaaaattaaagcggttgtttgtattttcatgaaaaatatggtatattgttatcagtaattagatacttcagagcgagtgagcagaaatgctcactctttttattggagcacgtctaatctgaaatataaaaatgaattggagggaatcatttgagtaccgttgtggaaacagttcacgatctgattgtgccgattcttgatcaacaccattttgaattagtggacattgaatttgttaaagaaggtagcagttggtatctgcgcgtcttcattgacaaaccaaatggcattgaccttgaagattgtgccttagtaaacgatgcgttaagtgagaaactggattcaatcgacccggatccaattccgcaggcttatttcttagatgtttcatcacctggtgcagagcgtcctttaaagaaggaagccgatttccaaaaagcacttggcgaatacattcatatctcgttataccaagctgttgatggcgagaaaatctatcaaggtacactaaaagcccttgatgatgacactttaactttagtgattaaaattaaaacgcgtcaaaaagaagtaacgtttaatcgtaaggaaattgccaaagctcgcttagcaattgaattttagtaaaggtaggctagttacatgagcaaggaaatgttaggtgcacttgatgcgctagaacaagaaaaaggcgttaaaaaagagatcgttattgaagcccttgaagcagcacttgtttctgcttataagcggaattacggtcaagcacaaaacgtggaagttgaatttgatcaaaagaagggtaacatccacgtctatgctgtcaaagaagtcactgacgaagtgtttgattcacgtcttgaagtgagctaccaagatgctttggaaattaacaaggcatacgaagtgggcgatacaattcgttttgaagtcacaccaaaagacttcggccgaattgcagcccaaactgctaaacaagtgattatgcaacgggttcgtgaagctgaaagaagtatcatttacaatgaatacagtcaatacgaaaacgaaattatgcaaggggtcgttgaacgccgcgataacaagttcatctatgtcaacttaggcaagatcgaagctgttttaagcaagcaagaccaaattccaaacgaggaataccaagcacatgatcggattaaggtttacgtttcaaaagtggaaaacacaactaaaggcccacaagtctttgttagtcggacacaccctgatttagtgaaacgtttattcgaacaagaagttccagaaatttatgacggcaccgttgaaattgtctcaatcgctcgcgaagctggcgatcggacaaagatggctgttcgttcaacagaccccaacgtcgacccagtcggcacctgtgttgggcctaagggacaacgggttcaactagttgttaatgaattacacggcgaaaacatggacattgtgaagtgggaagaagatccttcagactacatcgccaatgccttgaatcctgccgaagtcatcgctgttcaatttaacggtgataacgaacatacatgtacagtcatcgtccctgattatcaattgtcattggcaattggtaaaaaaggtcaaaatgcacggttagctgcgaagctaacgggctacaagattgacatcaaacctgaatctgaagtcgaattcgttgatgaagacgacagtcaagatgaaggtgcagtcgttgaaggttttgaagaagaaacaacagaagctgttgaaggcttcgaagaccaagcaacggattctgctgttgattctgaagaacaaccacaagaataagtgaggtgttcatgatgaaacaaagaaaagtaccaatgagaaaagacgttatttcgcaagaaatgaagcctaaaaaagaaatggtgcggattgtaaagactgccgaaggtgagattaggattgacccaactggtaagaaatcaggtcgtggcgcttatgtttcactagaacctgatgcaatcaagaccgcccaaagcaagaaaattttggaaaagacgtttgggattgacgttgcagaatcattttatacagaattattcgaatatgttgatcatcaaaaggctcggctagaattatttggagaacgaaaatgagtgaacaaccagaccgtttattacaactcttaggtatttgcatgagagcacggcaactggtcagtggtgaagaacaagtcctaaaagccattcagcagcaaaaagcgaaattggtttttatcggctcagacattagccaactgacacagaagaaattgactgacaagagtcatttctacgaaatcccggaaacaaaagcgtataccgcggcccagctaacccaagcaattggattacatagagccaccatcgcggttgttgatgccgggtttgccaaaaagatgataacgctactgggataataaaggagcgtgaagatatgggtaaaaaacgtatctatgaattagcaaaagaaattaacgttgccagcaaagatcttttagaaactgccgttaaaaaaggttacgatctaaaaaatcacatggcaactatcgatgacaatcaagaaaaagctttgagagccatcttccataaggaaacaaaaccagctgctacagcaactgacagcaagccagccgcagcacctgctacaccaaaggcaagcgaaaaaacagataacggtaagattaagattaacaaagccgctatccgtcgtcgtccaggagctagcagcaaaccagcacctcgttcaaacaaccaacgcccacaaggcaaccggaatggccaagcatcaaatggtcaaaaccgcaacaatgccaatggtcgtcctaacaacaataacgcccgtcctaataatggtcgccctaacaataatgcggctaaccggacaaacggcaatgcgcgtccagctgggtcaaaccaaccattgagcttgcaagaacaaatctcacaagctaatgcacgtcgtcaaagaacacaagaacgcattcaacaacaacgtgaacaacgcgaagcagacgaaaagaaacgccgtcaacaaagcaagcgcccacggccagctgctaaaccaaacggtaataacagcagtcgtccagccggcaacaagccagccggcgcacgcccaacgacaacaaataatcgtcctgcaaacagcaataacaacggccgtccagcaaacaatacaaacagccgtcctaataacaactcgaaccaaagtcggccagtttcggcacaagaaatgcaacaaaaaatgcaagctaatacggtgagtgctgctaaaccagcatcaaacaatacagcaagcaagccaaagaactttggtccagataagaaacgtggcggcgggtataacagatacggtaacaatcaacaacgtttcaataagaaacgtaagaagacccgtaagcaacaattagctgaacaaaatgcagctaagaaggaaatgccacaacgtaaagaacggccattaccagaagtattagtttactctgaaggcatgaacgttgcggacatcgctaagaagattcaccgtgaaccagctgaaattatcaagaagttattcatgttagggattatggttaacatgaaccaatcacttgataaggatacaatcgaattattagcaacggattacggcatcgaagcagaacaaaaagtggaagtggatattgctgatatcgattcagtatttgaaacagaagctaagagtgatgctaaccttgtgagccgtccaccagttgtcacaatcatggggcacgttgatcatggtaagacaaccttattggataacttacgtaacagtcacgtgactgttggtgaagccggtgggattacgcaacatatcggtgcttatcaaacgaagttaaacgatcgtttaatcacattcttggatacacctggacatgcggccttcagtaacatgcgtgcgcgtggtgctgatatcactgatatcatcatcttagttgtagctgctgatgacggtgtgatgccacaaacaatcgaagccatcaaccatgccaaggctgctaaagccccaatcatcgttgcggtgaataagattgataaaccaggcgcaaacccagatcacgtcatggaacaattgatgggttacggccttgttcctgaagactggggtggcgataccatctttgttaagatctcagctaagactggtgaaaacattgatgaattacttgaaatggtgcttcttgaagccgatgtgcttgaattgaaggctaacccagatcaaaaagcggttgggacagtgatcgaagcccgtcttgataagggtaaaggacctgttgcatcactcttgatccaacaagggacattgaagattggtgatccagtcgttgttgggaatacctttggtcgtgtccgtgtcatgacaaatgatcgcggtcgtcgtgtgaaggaagtcttcccatcagaaccagttgaaattactgggttgaatgatgtgccacaagcagctgatcgtttcgttgtctttgaagacgaaaaaacagctcgtgctgctggtgaagaacgtgctaaacgtgcgctcttgaaggaacgtagccgttcaaaccctgtcacattagataacttgttcgaaacaatgaaacaaggcgaattaaaagaagttggcgttattatcaaagccgacgtacaaggttcaacagaagccttggctggtagtttacggaagattgaagtcgaaggcgtgcgcgtgaatattattcatgaagccgttggtgcgattaacgaaagtgacgtcacattagctgctgcaagtaacgccatcatcatcgggttcaatgttcgcccaacaccacaagctaagatccaagccgatgctgaacaagttgatattcgtttacaccgaatcatctacaaggcaatcgaagaaatcgaagctgctatgaagggtatgttagaaccagtttacgaagaaaaagtaacgggtcaattaactgttcgtgaaacatacaatgtttctaagatcgggacaattgccggttgtatcgttgacactggcgttatccaacgtgatagtggcgtccgcttaattcgtgacggtatcgtgatttatgaaggtaaactttcaagcttgaaacgtttcaaagatgacgttaaagaagtcaaaactggctttgaatgtggtgtgacaatcgaagattacaatgatattaagattgatgatcaaattgaagcctacgtgatggaagaagtacctgttaaataattaatttacaggaggacaagcaatgaaacatcgtgttggtcgggttgaacaagaaattcaacgcgaaataaatgacatattattaaaaagagtgcgtgatccccgagttgaaggggtcacaatcactgatattaatctcagtggtgacttacaacatgttaaagtttattacagcattttatctggcttagcaagtgacgctgaaaagacacaagctggcttagataaagctaaaggattgattcgcagcgaacttggccaacggattaagttgtacaagattccagaaatcacctttgaacaagacggttcagtgcgttatggtgaacatatcgacgaacttttacgtaagttacacgaagatgaagcacagcgttaaactgtgaaaaagagccccgcgaaagcggggctctttttttgtttgaatgaccttatggaaatgataatctattaaattgacttagtcgtttgcaccatattactattctttcaaaagttgattaaatatcgaccgttaaaatatatcgtccaacgctatcggcggcgaattgttaagcgttatacagaggccttatcagtatctaatcgctggttgcagttttattattatcaacgagaaatatcccacattattccacagattctttattatttagaggctaacccggcattagaaacgattgatgatgcgattgcttatattgatagtcagccggttagttcagagctgtatcaaaataacttaagcgagtttcgtaaataggttaagcagtttaatacaatggtgctgagtacagcgaacaacctgggacaaccgtctagtcgacagattaattttgtcacgcttgatgggataccgaatgtctggtattttggcaccgaccccgaagcgccgaaagtcagtgaactcgatttggggcgagccgcaatttttacgctaccgactagtgaagaattgagaatcacgagtaatcggctcaaggtataccgaactcagtatcgttttagtgatatagcagaggcctatcaaaaacaagtaccaggctatgttgagagtttatccaaagaagaacaggaaaaagagattatttttgcgatcgaattaaaaagtgctaggatcgatagtcggtttcaaaataaaggactcactttttccgagtaaaaaaggttactgataaaacaacatagagcgaggatgggcaaaagtttcttttgtcccatctttttttgtgctttgataataaattgagcagcatcataaagctaatcccgttcgacttcacactctatgctataatagtttagttaatacttaaaggagattacttatggacggcattgtacccttatataaagaacgcggcatgacgagtaacgattgtgtgtttaaagtgcgccgcattttacacatgaagaaagtgggccattctggcacgttggatcccaacgtcgatggggtgttaccaatctgtatcggtcaagcaacgaaggttgttgatcaattggtgcattctggtaaagtctacacgggtgaaatcacccttggcttatcaacaacgactgaagacttagatggtgaagtcgttgaagaggcgcgcttaacagaacctttttcaactgagaaaatcaaagagacgctcgctagttttctgggcgattcaattcagataccccccatgttttcagcggtgaaagtcaatgggcggcgtttatacgactatgcgcgcgctggtgatctagtcgaacggccacaacgttcaatcacgattacgcagtttgatttggatggtgaaccacaatttgacgcagaatctgggcgccaaacattccggttcattgtcggttgctcaaaggggacttatatccgcacattagctgttgatttcggtcgtaaactcggtttacccgcagtgatgtctgatttaacgcgtcttaagagtggcggcattcaaattggcaactgtatcacgttggaacaattggcgcaaaaaactgaagcgggcgaactggcagacgttttattgccaattgaccatgtgtttgaagattacaagaagattgctttagacgatgatcaatgggccaagcttttaaacggtgtgttcttgacattgccagaacaaaccgatgagattgtggcgttgacctatcaagggcatatcaaggcgctctatcaagttgaaaaagcagcgcaacatctttatcgcccttataaaatgtatttacaaaatcaagggactcattaaaaaaaactaggtgaaaaatatgcgtgtcattgaattaattcatccatattcaaaagaacaagtgccagctgaccaagtggtcttggcgcttggcttttttgatggcgtacatcgaggccatcaagctgtaattcggaaagcaaaacaaattgcagttcaaaaaggtttaccattagctgtgatgacgtttgatatccatcctgccattgtttatcgcaatgccgatcgggagtcattccgttatttatcaacggttgagcgcaagcaagaattgatggcggagttaggcgttgatgttttctacatcgtgcactttaatgaagcatttgcacaactagccccacaaacatttgtcgatcaatacttagtcgctttacatgcggatacagtggtggctggctttgattacacttatggtaaaaaagagattgcgaatatgacgacattgtcagactatgccaaagggcgctttgccattgtgacagttgcagaacatgaccataatggtgccaaaatcggctcgacattagtacgagaggatttagatgctggtaagattgcggaagctaatgaattactcggttatgtttaccaaacgaccggtgaagtagtgcatggtgaagcacgcgggcgagaattagggtttccaactgctaacatcgaatcgcaacgaccagaacgattaccaggaattgggatttatgcggtccgctttttagtgcgcaatcaatggtatattggtatggcttcaattggtcggaatgtgacgttccacagcaataacccggtaacggtggagattaacttattagatttcaatggcgatatttacggtgaacaagtgaaagtggattggtatcactacttacgcggcgaagtgaagtttgactccgcggaagccttgattgaccaactccaccaagacgaagccgatacccgaacttattttgagaaattagaggcacaacattaatggcaggcgcttatattcacatcccattttgcgagcatatttgttactactgcgatttcaataaggttttcattgaaggtcaaccggtcgatgattatgtcgatatgttgattcgcgagtttcaattagtgatggcagaatacccagacgaaccaattgatacgatctatgtcggtggggggacaccaactactttatcaccagcacaactccaacgtttaatcgatgggattcatcaatacttaccttatgagggtggtgagtttacgtttgaagccaatcctaatgacttacaagatactgaaaaattgcaagttctgaaggacaacggcgtcaaccggttaagtattggcgtgcagtcgtttaatgatcagattttaaaacagatcgggcggattcaccgaagtacggatgtttattgggcaatcgataacgcgcgcaaggtcggcttcgaaaatatgagtatcgatttgattttccgcttaccacaacaaagtgaagcggatttcatggatagtttgaataaggcaattgaactcgacttaccgcattattcgacgtactcattgattctcgaacgcaaaacaatcttctataacttgatgcgccaaggcaagttgcatttaccatcgcaagatgttgaagcacatatgtatcaagccgcgattgatagtttcaagcgggctggcttagatcaatatgaaatcagtaattttgccaagccaggctttcaatctgcgcataatctaacttactggcgcaatgaaaagtattttggctttggtgccggtgcttacggctatttaggtaaggatcgttaccataacttcggcccaatccaacaatacctagaacccttaaaagaaaataaggtgccagtcattgaacgccatgttctgccactgaccgaacaaatggaggaagaactcttcctcgggttacggacgatgcaaggcgtatccatcagtcattttcaagataaattcaattatccattacaaaatgtttacggcgaaacagttgccacccaaattgcaaagggctacctcaaacaagaaggcgattggttaagactaactgaatcaggtaagttcctaggcaatgaagtcttccaagagtttctgctagatagttattgagtgcgttcaaaccggggatattccgagcattcgccttgtgtcgctaagcacaggaacatggtttgaaaagtacgttaagaaaagaagtgtaactcgagctggtcaggctttgaggattaacggtaaaatggggattatggcggttcttgccatggcccccattttgcagttaaccggaaaaggctactcgaggagcacgttaaagaaaataagtgcgtcatcaacgggtaacttctgagcacttacagcatttgacggatttgcgatgaaatcgccgatttggcaagtgaggtaaggcggaagaagttgttgatgaaagcacgttacaaaaaaggacagtgattaatttggaacgggaactactgaatttacgggccgtttcacaagtatttgcttctaagtcataatgaaccatcaaaacttagaagcgaggctattaatatgcatcaaaatctttatcaccattggtccgaaacgaaatacttaaaggacatagtgaccaatcccttaattgaggttggcgactattcttatttttcaggttattacgatcatcaatccttcgaggacggttgcgttcgttatcattggggggatgatcactcacgcgcattatttgatccgcaggctgaatttggctggcagttaaatcgattgattatcgggcgttatgtctgtattgccagtggggtcgtcatcttgatgggtggcaaccataatcatcatccagattggatcagcgcctatccgtttcctgaataaatcgcgacgtcctatgaaccaaaagggaacacaatcattgaagatggtgcgtggattggcatgcgcgccatgattatgcccggcgtgcacatcggtcaaggggcgattattgcagctggagcagtcgttgtgaaggatgtgccagcgtataccattgttggcgggaatccagcacatgttttaaagcaacgatttactgaatctgaagttgagctactgcaagcactcgattggtaccaatggccaattaaaaaggttcaagcagcacagtccatcttagcgagtcattcagttgcagcattaaaacagtttgatcaaacctatcaataaaccacgaaaagcgcgttgctttcattataaaagcagcgcgcttttttattttgacctttagttgggcacacttctccgtctgaggtctgattttcagtaaatccgtaaaaaagccggtgcgtttcttgactttatttgacgttcttgctatattaataattgtaattagcactcatgatattcaagtgctaaaaagaggtgatgacatgctgaccgaaaggcaattaatgattttgaaagaaattattcgtctttttacagagagtggtcagccagtgggttctaagaagttaatggcagaattgccggtacacgttagttctgcaacaattcgtaatgatatggctgatttggaaagtgtcggtttaattgagaagacgcattcgtcatctggacgggtaccgtcgatgcaaggctatcgctactatctagaccatctcatgcaaccagcaaccctcaatccggttgatgtggcaacggtccaacaatcatttggacagcactatcataagattgatgaaatcgtctcacaatcggctaatatcttatcgaacctaacgagctatacagcaatcacgttaggaccggaagtggctgagattcggttaactggttttcgtctagtaccgttgagtaatcaccaagtgatggcgattatcgtgacgagtgcagggacagttgataatcaggtatttaccattccacaagcgatttcgggtgatgaactcgaaaaagccattcgaatcattaatgatcacctaattggcttaccgttaaccgtggttagtcagaagttaaagacggatgtaccggcgctattagcccagtacatggcttctccgaccggctttttagacatcttcgacgatgttttgaaaaaggcgagtcaagagcgcttatttgttggcggtcagatgaacttgttgaatttttcagagttctccgatgtcacccagctgaagtcgttgtataacacgattaatcgttcagatgatttagccaagttgctagatttgtcccctggaggcgccaatagccaagttcaggttcgcctgggcaccgagatggccaacgatctgttgaaacattatagtctaatgactgttaattatgacgttggtgaacacggacagggagtcattgcactactgggccccactagcatgccctattcgcggatgattgggttactcgatttattccgtgaagagttagcgaagaaattaattgattattatgcgaatttcgatgatgatcaatcttaaaaggagcgtgtttgtttgaccaagcaagaaaaggctgagaaacaagaaaagccagtagcagaaatgccagaaacagaaacacctaaagaagaaacgccatttgaacctgaattagaagcagatgaagtgatcgaagatgctgcacctgacgaagatgcagccaagccagatttagcggctcaacttgctgaactccaaaagaaatatgatgatttagaagatagtttcttacggtcacaagctgaaattaaaaacattcaaacccgtcatcaaaaagaacaagctagcttgttaaaatatgatgggcaatcacttgcaaaagatgtcttacccgttttggataatctagaacgtgcgttggcaactgaagcaactgatgatagtgctgagagtcttaaaaagggtgttcaaatgacatacgatcatatgaaacatgctttagaagatcatggcgttaaagaaattgaggcgcaaggacaagcctttgatccgaccattcatcaggccgtgcaaacggtcgctgttgatggtgatcaaaaagcggatactgttgtacaagtcttccaaaaaggctactacttgaaggaccgcgtcttaagaccagcaatggtcgttgttgcacaataaattaaactaaaaatctaaaaaaagagggtattttttatgagtaaagtaatcggtattgacttagggacaaccaactcagctgttgccgtattagaaggcggacaaccaaaaattatcacaaatccagaaggcgcacggacaacaccatctgttgtgtcatttaaaaatggcgaaatccaagttggtgaagtggcaaaacgccaagcaatcactaaccctgatacaatcgcatcaatcaaacgtcacatcggcgaagcaggttacaaagtaactgttggcgacaaatcatacacaccacaagaagtttcagcaatgatcttacaatacatcaagaaattcgctgaagattatcttggtgaagaagtcacagaagctgttatcacagtacctgcttacttcaatgattcacaacgccaagccactaaggatgctggtaagattgccggcttagatgttaaacggattatcaacgaaccaacagcttcagcattagcttacggtttggacaagacagaaacagacgaaaaagtcttagtttatgaccttggtggtgggactttcgacgtttctgttcttgaattaggcgacggtgtcttccaagtattatcaacaaacggtgatacacatttaggtggggatgactttgatgaagccatcatgaactggttagttgaaaacttcaaatcagacaacggtatcgacttgtcaaaagacaagatggctatgcaacgtctaaaagatgctgctgaaaaagctaaaaaagatttatctggtgtgacaagcacccaaatcagcttgccatttatctcagccggcgaaaacggtcctttacatttggaaatgactttatcacgtgctgaattcgataagttaacatcagacttagttgaccggacaaaagcacctgttatgaacgctttgaaagatgctggtctagaatcaggcgacatcgacaaagtcatcttaaacggtggttcaacacgaattcctgctgttcaagaagctgttaagaactggacaggcaaggaacctgatcactcaatcaaccctgacgaagctgttgctcttggtgctgctgttcaaggtggtgttatctcaggtgacgttaaagatgttgttttacttgatgtgacaccattatcattagggattgaaacaatgggcggtgtcttcacgaagttaatcgaccggaacacaacaattcctacaagcaaggcacaaacattctcaacagctgccgacaaccaacctgccgtagacatccatgtcttacaaggtgaacgtccaatggctgctgataacaagactttaggccgtttccaattaacagatattcctgctgcacctcgtggtgtgccacaaatcgaagttaaattcgatattgataagaacgggattgttaatgtttctgctaaagaccttggcacaaacaaagaacaaaaaatcactatcaagagtaactctggtttatcagacgaagaaatcgatcggatgatgaaagaagctcaagaaaatgaagaagccgacaacaaacgtaaagaagaagttgatttgaagaacgatgttgatcaattaatcttccaaacagataagactttgaaagaacttgaaggtaaagtttctgacgaagaattacaaaaggctaaagatgctaaagaagaattagtcaaagcacaacaagaaaacaactttgaagacatgaagacaaaacgcgatgcgttgagtgaaatcgttcaagaattaacagttaagttatatcaacaagcgcaagaagcacaacaagctgctggtgctgaaggtaatgcaactgacggtaagtctgacgatggtactgttgacggcgacttcgaagaagttaaagacgacaaataataatgcgttttaaaaaaagccaaaacctagtatggtctagggccttggctttttttaatcagtcaattatgctatccttgataagatagatttaacgcgtaagtatatgaatggaggcccacaatggctgataaaagagattactatgacgtcttagggataagtaaagacgcctcagatgatgagattaaaaaggcctatcgtaaactttcaaagaagtaccatccagatattaacaaagccccagatgcagaagccaagttcaaggaagtcacagaagcgtatgaagcattaagtgacccacaaaaacgggcagcttatgaccaatacggtcatgctggtatgaacggtggtttcggcggcggcgcaggccaaggcttcggtggcggctttggtggtgctgaaggcttcggcggtttcgaagatatctttagttcattcttcggtggcggcggtgctcggcaacaaccaaacgctcctcgtcaaggttcagatttacaatatcggatggatttgaagttcgatgaagccattttcggcaaagaaaccaagatttcttataaccgtgaatcagaatgtcacacgtgtcatggctctggtgctaaaccaggaacaagcgcccaaacgtgtcacaaatgtcacggtgcaggtcaagtccaagttgaacgacaaacagctttcggccgcatgatggctcaagaagtctgtgatgtctgtggcgggactggtaaagaaattaaagacaagtgtgaaacatgtcatggaacaggtcacgaagatgaacggcatactgttaaggttaaagtgccagcaggtgttgaagatggtcaacaaatgcgtcttcaaggccaaggtgaagccggcacaaacggtggcccttatggcgatttattcatcgtcttccgcgtggcaccaagtgctgaattcaagcgcgatggcgcacaaatttattcagaagtcccaattagctttgtccaagctgctttaggggatgaaattgaagtcaacacagtccatggtcctgttaaactaaaagtgccagcggggactcaaacgaataccgtcttccgtctacgtggtaaaggtgcgcctaagctccacgggacaggtaatggggatcaaaacgttacagttaacatcgtgacaccaaagaccctcaacagtaaacaacgtgatgcgctaaaagcatttgcagtcgcaagtggtgactcacttaacccacaagacaacaacttgttcgacaagattctgaacaagaaacacaaaaaatagaagtgcgtcaaaagtggttatcctgtgaggattagcctaacagggcgaatgattgctgtaagcaatcgtttgacttgtgtagctaaccggaataggatgcttttgaaagcaggttaaaaatagaagtgcgttcaagccggttatactttgaggactagcctagtttcgtgaatgagcgacggagtcgatcgtttgcgggacgtagctagccgcagaagtatggtttgaaaagcacgttaaaaatagaagtgcgttcgagccggttatactttgaggactagcctagtttcgtgaatgagcgacggagtcgatcgtttgcgggacgtagctagccgcagaagtatggtttgaaaagcacgttaacccccctctaatccacaagattagagggctttttttgttggagtggataggtgggagatttttgaaaaattctgttataatggcggtaataaattaggacggaaggtgagttgcatggatgacaaagacaaattagaactcgaaattgcacgccttaagatggaaaatgagaatttacggttgaaagctgaggttgaacagcggaagaataataagtactggttgtgggcattagtgccaattgtcgcgattcttgctggcaacatgacctcattttcacggatgttcatgcatttttgtagatagttcacgatagattgcatagaaataggcgttaagcagattatgaaaactgcttaacgcctattttttattggcgactgtgacggtagccgtaactgaagtaaattgttaggccaatcaccaaccagattaagaagacaatccaagttgttagttgtaactgggtcatgagtagtaagcataagccgcatgaaagtaaaggaatccatgggaatagtggcactttaaacccttgtggcaattcattataaaatggtaacttgcgcaggaagatcacaccgagagaaacagttgcaaaggcgaataacgtgccaatgttgaccaattcagcaatcttatcaagtggcactaccattgcgacgatgcttgtgacgatggcgaaaatccatgtattcgcaactggcacatgtgtttttgaactgactttggcaaaaacgggtggcaatagcccatcgcgactaatggcgaagatcagacgtgttccgccgtaggtcataacgagtaggacagttgtcataccggcaactgctcccagggcaacaatcccagcaacccagttttgatgcatcaattgaagcgcaaaagcaacggggtcaccaacgttgagttttgtatagtgcacgacgccaacgaggacggtggcaactgcggcatataataatgaagcaatcaataatgaagcgataatcccgattggcatatcacgttgcggattgacaacttcttctgatgcggttgaaacggcatcaaagccgatgtaggcgtaaaatgctaaggctgccccagaaagaatgccatcagcaccaaatggtaagaacggtttgaagttggctggtttcacatagaaaatggcaacgccaaggaaaattacgatgacagcgactttcacaccaaccataatcgtattaatccgtgttgattcgcgtaagccatttgatagtaagaacccaatcaataacgtaattaaaccggcaattaaattaataccaccagggtggtcaggcgtccatgcagtcgataagaaggtaggtaagtgtaatccaaagccagcaattagattttggaagtaggctgaccaactgacggccactgaggcgactgcgaagagatattcggaaataagcgcccaacctagaatccacgcgattaattcaccgaagacggtgtagacgtatgtgtaggcactaccagccaagggaattgtagaagcgaattctgaataacaaagggcagccattgcacagacgactgcagcgagcaggtaagacagcatcgcaccgggtccagcatatttagcggcgataatccctggtgtgataaaaataccggcgccgacgactgcaccaacccccatggcggttaaaccaaaggcggttaaatggcgttctagtgtactatttttaaattggttcacgtcgatttgttttttggcaaagagtgaatgttgtgtcattagtaactcctttttaagtgatatgattctaattttaatcggtctactgagaagcgtcaagataaaaaagcgccatgacagtgattgagccgtcatggcgcggattagttaagtgattaaattaagccccagtggcgtaaaccttcaataatgccaccttcagtattcttagaagtaatgtattttgccttggctttagcttccggaataccattgcccataacggtgggatagtctacgaagtcgagcattggtaagtcgtttgtaccatcgccaaacgcataagttgggatgcccgttaagttttgtgagcgaatcaattctttaataccggtttgttttgaacaatctttttcaaccgtatcaattgagttcggtgtgttgcggtagaatgttaagtcggtacttagtgtttctgtataggccttgtcattgtcgtttgtgagaatcaacatcatgtagactggatgattcaagtaatagtctggatcaacttcggggacgggagcgttgacaaacttgtaggcatctttgccgggttgagttacagccgtaatccggattgcttcttcattataaaaagcgatggcttcgtcagcagcattagcaattgcgacggttttttcaatcacggtcgttggaatagtgcctttataaacaggttgaccttcatattgaatgaagctcccatttaaacaaatgaatgaatcgatgccggttttggcaagtgcatcttgaatttcaagcggtgagcgaccggtcgcaatgattggtaagtagttgttggcgcgtaattggcggagtgcaatcgcaacagctgcatctacttcagaatgttcgttgtaaagtgtaccgtcaagatcgaaaaatactagtcctttataagttattaataaaaagctacgcccttttttaaagatgacgttttgccaagcacgcttgataaaattcataagtatttcctccttaaaactgaataaatattagtttaggcgggaaatatgaataaattgtgtttgaaaataggaatattcaacgattattttaagaatttatcgaaattgtgatgtgtttaattaataaataacttagttatctataaaaaaattaaattaatttgaatttgtttgaaaaaaataaatgctattaaatagcggttttcagaaaattatcgcgtatatttccacttgtctatctttatagatatgtagtatagtgaattgtaatagtgaatcatttaattatacttgagacgttgatcgttatttggaggggttgtacgtgaaagaaattgatattcgtaaattagtcttcgcaaatcaacaagtcattccgaatacgctcgctaatctttcaaaagttggtaatgcaatcttgtacattgttgatgttgaggggcatttagtgacagaggtatacggttctctcgaaatggagccagcgatgctaatcaatgatgatacaagtgttgatttaacgattagtgggattcaaaagcatgattaccaactagagcatacttcgttacctttaaagattaaacaattaaatgaaattgttggttatatttgttgtgcccgatatattgataaaaataagtctgatcagaccggttatcgaagaactgtgacagagcagctagaagagataggcgagctcgttcaatcgttagtgcaacatctattaagattgaatatattggaattgggatcagataaatttatatttgaaattcaagagccacaacaagttcaagaaccacacgtgaaattatcagcatcagaaacaatggcgaaattacgacaaatagcagtgtcaaatggcatgattattaaagcaattcaatttattgatgaaaatattgaacgaccgttaactttggacaaggtagcagcgcatgtttatttatcaccgtattattttagtaagttatttcggaaggaaactggttttagtttttcgacatatctaagtgcgcgtaaaatgcaaaaggcaaccaaattattagccaacaaaaaactaaccgtgaaagaagtcgccgtacggctaaactacccacaggttagttattttagtcagatatttaaaaaatatattaattgcaccccgtcagagtatcgtaaacgaattaactcttagtaatattagtgacggagaaatgtaactgattctcaaaaaaataaatgacagattctaagctagaatggacgtctgacaccttaccagtaataaatacagagccactaaatcggtcaacaaatccaacgtcaacggcgcccgatttaagtgcttgatcgcctgcaatgatcgccgactcagaaggtgtaacagtaatgattccgattgcgtcgtgacaatcgttaagccctaatttttcatatagatctcgtgttggactagcgacgatatgggctaaagagagttgtttaccagggacgtattcttgaataatacgttctagacccgtagcatgtgccataatttgaaccaccttttatgattaattattttgaatgagtgaatagaattctgcacaaagattgtgcagaattttttttgtttcggaatcgattaattgaccatcagtcgaaaatttatcaggtgcattacctacaagacattcagttttatgtgtgatacaggcgttaataccgggtgatgttaaaatttggcgaagatgttgttgtgcccggacagttcctaagtgtcccgtggacgcaccaagtaacatgattggtttatgttgtaatgttgaagggtctaatgaacaccaatcgattagattcttgatgtttgcaggaacactataattaatttcagaagttgcaatgattactccgtcagcttcgtggagtacatttcgtacgtaatcaagatcggcttgatatttttcagcattttcagctgatagaaagggtaattgattaatagaaagtaattgaatttgaaatacatcagcgcagtgaagtttcaaataatgaagcagacgtaaattagaggatagtggtgaatcactgccactaattgcaattatcttatgaaccatatggaagactcctaacgtgaaaggtactagttagaatatgacagtcaggaaaaaatttttcaagaggcttccttgaaaacgcttaatttttaacaattttatttaaaaacaacaataaaatgatacttcaaactaaaatagttataaataacaactaattgttagaattctgtcgaattatcaccaataaggaattgttaatagaaaacttatagaacagttatgggtcttttaaaggttgctatatcagtgttttttaatagctaatgtagattattagaccaattaatgacactttaagaatgtggaaaactagaagatagcgaaaaatcaacaagcgctttcactataatgtaagtgtattcattttatagattaaaaatttggaggtcgtcattatggcattagaagcattaggcatgattgaaacaagaggattagttccatcaattgaagcagcggatgcaatggtaaaagctgcaaacgtcagtttagttagtcaagagaaagtaggacatggcttagttacaactatggtccgtggtgatgttggtgcggttaaagcagcagttgatgcaggtgttgcagctgctgaaaatattggggaagttgtttcaaactttgtcattccacggcctcatgaagaaattgaaaaattaatcaaaatgcaatcaaaactaacacaggaataagtgattgatagatggcagatcaaaatgaacagttagtcaccgatattttaagtaaggtactacaatcaaacgacattaatgaagtcacaaacggggtgaatcagatgaaggatgttgcgattaatctaaccgaatttgtgggaacagcaccaattggcgatacaatcggcatggtcattgcaaatgttgaccgtgatttatttgccaagttacatgtcgaaggggattaccgtgcaattggaatcctctctgctagaacgggtggcggaccacaaatcatggcggccgatgaagctgttaaagggacaaatacaacggtcatcagtgttcaattaccaagagatacaaagggtggcgctggtcatgggtcattaattctaattggtggtcaagatgtttcagatgttagacgcgcaatcgaaattgcgttagaaaatgtcccaactcggtttggtgacgtgtataacaaccaggctggccatttagaattacaatacacagctcgtgctagtcaagcgtgtcatatggcatttggtgcgccagaaggtcaagcatatggtttaattgccggtgcacctgctgggattggtgttgtaatggctgatacggcattaaaggcagccaacgttgaagcgattgattttgcttcacctggttttggaacgagttattcaaacgaaggtattctgcacatcacaggggattccggtgctgttcgccaagctgttatttcagctagagaagtcggcaaacaattactgggtactctaggtgatacgccaatgaatgattttccttcatatatttaaggaaagtggggtgcaattttgaaacgacaaaaaagagttgaagaattagaaaaacgtcctgtccatttagacggttttgtcgatgaatggccagaagaaggtttaatcgcaatggaaagtcctaacgaccctaagccaagtgtacgagttgaaaatggtaagatcgttgaaatggatggtaaaacggaagctgaatttgatttaattgatcaatttattgctaaacacgctgttgtgactaaggtcgctgaaaaagtaatggcgatggattcattagaaattgccaataaattagttgatcctaacgttcgtcgggaagaaatcattccgattacaactgcaatgacacctgctaaagcagctgatgttattagtaagttgaactttgcagaaatgattatggcttcacaaaagatgcgaccacgtaaggcaccagcgacacaagcccacgttactaatattcgggataatccagtgttgttagctgccgatgctgccgatgcagcgttacggggtttccctgaacaagaaacaacaactgctgttgcgcgttatgcaccattaaacgcgatttcaatcatggttggctcacaaactggtcgtccaggggtaatcacacaatgttctgttgaagaagcaatggaattgaacttgggaatgcgtggctttacagcatatgctgaaacaatttcagtttatggaacagagcgagttttcacggatggtgatgacacgccttggtcaaaaggctttttagcttcttgttatgcttcacgtggtttgaagatgcgctttacttcaggttcaggttctgaagtcatgatgggttacgcagaaggtaagtcaatgttataccttgaaacacgttgtatcttcatcactaaaggctgtggggtacaagggctacaaaacggtgctgttagttgtatcgggattccaggagctgttccatctggtattcgtgaagttttaggtgagaacttactctgtatgatgttagatattgaatgtgcttctggtaatgaccaagctttctcacattctgatattcgccggactgaaagactattaggtcaatttattgccggtacagactacatttcatctggctactcatcagtaccaaactatgataatacgtttgctggttcaaatacggatgcgaccgactatgatgactactatgcaatgcaacgcgatcttaagattaatgccgggattattcctgctaaagaagaagatttgattaaagtacggaacaaagctgctagagctttacaagctgtctttaaggcgttggatttaccggttattacggacgaagaagtagaagctgcaacttatgcctatacttctaaagatatgcctgaacgaaatatggttgaggatatgaaggcagcacaaggaattctggaccgaaacattaccggtgttgatatcgttaaaggcctctatgaaggtggcttccaagatatcgcggaaactgtcttaaagttattacaacaacggattgccggtgacttcttacaaacatcagcaattttcgataaggactggaatgttatttcagccgttaataatggcaatgactaccatggcccaggtactggatatcatatcgatgatgagctatgggaaaagattaaagcgataccaatggcaatcaatccgtctaatgtttagattgattactgcaaaaaggaggccagtaattcatggttgaagttaatgaagatttactacgacagattgttaaacaagtcattgctgaagcacaagaagttgaccgtaaagttgattttagagggtcggaagtgacggaaaagcctgctcctacggcacccaatgttggtcaaccagaagcaacggatgcaccgcttaagcttgattggttcaagcggacgggggttgctaaaaagggaacgacaacggatgaagttgtcattgcagtattacctggttttgcagaacatatgactgagaacatgacagggattgcacacaaagaaattctacgacaaaccattgctggaattgaagaagaaggattaaaagccagagtaattaaagtttacagaacggcagacgtttcatttgctggcgctgaagctgatggttactcaggatcaggggttgcgattgctattcaatctaaagggacaaccattattcaccaaaaggatttggaacctttatcaaatcttgaattgttcccacaagcaccggttattacaccagaaacataccgggcaattggtcgcaatgcagcgcgttacgctaagggtgaatcaccaacacctgtaccgactgtcaatgatcaaatgtcacgggttcaataccaagctaaatcggcattgatgcatattaaggaaacgaaatatgttgtggttggtaaagaacctgaagaagtcgaattaaactttagttaacagaatgtgggtgagaatatgtctgaaattaatgatctaattaataaaatcgttaaagaagctggtcaacaagcaccgcattctgaaacgacagtcccaactaacaaagcagataagcaagctggtcacactaaaatgactgcagctgattatccacttttcaagaaacatcccgaaatggtcaacgcaccaaacggaaagaacattaatgaaattacgattgaagcagcaattaacggtcaagttaaaccagaagatttgcggattgcaccagcaacattgaaagcacaaggtgaaatcgctgaaagtgctggtcgtggtgctttgaagagtaactttgatcgggcagctgaattaacagctattccggacgaacgtcttttagaaatgtacggcgcacttagaccatatcgttcaacaaaggaagaattattagctattgcagacgaattggaaaataaatataacgctaagattacagctggttttgtaagagaagccgttgaaatgtatggtattcgtaagaaattcaaaggagataactagtttatctcaagtgaggactgattaacttgaaaagggtcataggtgttgatattggtaactcgtcaacagaagtcgtgcttgccgaaattgaatcagacggacgcattcagtttattcaatctaatattgcagaaacaacgggaatcaaggggactaagcaaaatctatttgggattaaaacggcgattaatgggttgcttgaaaaatgccaactaacaatcgaagcagttgatctgattcggattaatgaagcaacgccggttattggtgatgttgcgatggaaaccattactgagacaatcattactgaatcaacaatgattggccataatcctaagacacctggtggtttgggattagggattgggtatacggtaaacattgcggaattgcatcagcgaactgataagagtcgccaatacatcgttgttatccctaaaacgattgattttgcggacagtgctaaactgattaacctttactggcaatcaggttaccaaattacggcagcgattttacaagcggatgatggtgttttagtcaataatcgacttgataaagtgattccgattgtggatgaagtcgcctatatcgacaagattccactggacatgttggcgaccgttgaagttgctgataaaggaaaagtaattacgcaattatcaaatccatatgggattgcgacagtctttaatctaaattcggatgaaacaaagaatatcgtcccagtttcacgcgcattaattggtaatcggtcagccgtagtgattaaaacgccagagggtgatgttaaggcacgggttattcctgctggttcgattacaatccaaggtgatggacgaacacaaaccgttgatttagctgctggggcagataaaatcatggcggctgtttcaacctttaaacacattgataatgttaatggtgaagcaggcacaaacattggtggtatgctcgaacgagttcgtcaaacaatggcggacttaacgaacaagacattggatgaaatttttattcaagacttactagccgttacaacgtctgtcccgattgatgttaaaggtggtttagccggagaattttcaatggaacaagcggttggaattgcttcaatggttaaatctgaccacttacaaatggcgatgattgcgactgaaattaagaaagagttccagtcgattgaagttgaaatcggtggtgcggaagcggaagctgcgattctcggggcattaacgactcccggaacgacggcaccaatggcaattcttgatcttggtgccggatctacagatgcatcgatcatcaatgcatctggcgaaacggttgcaatccatttagcaggtgcaggcgacatggttacgatgattattaattcggaattaggtttagatgatcagtatttagccgaagatattaagaaatacccgttagcaaaggttgaaagtttattctttatccgtcatgaagatggcagtgttcaattctttgataaagctcttccgggaaatttatttgcaaaaacagtagttgatacgccaaatggttttgtccccattccaggtgatttgaacattgaaaagattaagcgtattcgtcaaactgccaaaaaacgggtgtttgtagaaaatgccattcgtgctttgaagcatgttagtccaaccggtagcattcgtgatattccgttcgtagtcattgtgggaggatcggctttagattttgaaattccacaactagtgacggatgaattatcacgatacaacttagtggcaggccgggggaatatccgtgctattgaaggccctcggaatgctgttgcgacaggcttgattctggcttatgcagaaagcatcggtgtatgacatgactaaaaaaccagaaatcattattgctagtggaattgatgatacgttgattcaaccacttctgtacggtattgaagaagaagaaattcctttccaatttgctgaaatagatggtcagacaacggtcgaacgtgcttatcaaagtgcaatcgaatcgcagttatcagtgggactagcctatgacagagattacgcctatttacattttaaaaatttgccagcggcggaaccactatttaaagttgcgatgaatcgacctgatcaattagatcgactgggtgctaatgcagcacgactagtcaagggtgtaccatttaaagaaatcgattaaaggaagtgttagaatttgaacgcattaggattagtagaagtcgttggcttttcaaccgcagtgtatgttgcggattcgatggttaagacagcagatatcacgattagtcgcttagaacgaaccaaaggtgccggctggatgacaatctatgtcaacggtgatgttggcgctgtgcaagctgcagtctctgatggtcaagctatggcagaagccgcagacaagtttgtgacagctaaagtgattgcacgaccaacagacgagcttggcaagtttattactaaaaagtcagctactaaagtggcaccaaaaatagaaccaaagacaacaaaaacagaatcaaaatcatcaaaaaataaaaaataaaacagttttctaggaggaaaatattatgaataacgcattaggaatgattgaaactaaaggtttagtcgcagcaatcgaagcagcagattcaatggttaaagcagccaatgtatcactcgaaggctacgaaaaaattggttcaggtttagtaacagttatcgttcgtggggatgttggtgctgttaaagcagccgtggacgcaggtacgtcatcagctgaaaacgttggcgaagtggtatcaagctacgtaatccctcgtccacacacagatgttgaaaaaatcttgcctagcaaataagtaatattcgttttaaaaggttaattaagttggaggcaagacataatggacgagagccaattaagaacaattattcgtaaaattattgatgaagaactaaatgggataccaagcattccggttggtgtttcgaaccatcatattcacctaacagatgaggattttgatcgtttattcccgggacaaaagatgacggtatttcgtcaattgaaacaaccatctgattttgcttctgaacaaaaagtcacattggttggcccaaacggcgttgaaattaataatgttagaattcttggtcctacacgtaaacatagccaagttgaaatctctaaaacagaagcattccaattggcaattgatgcaccaattcgcttatccggtgacttagaaggtgccccatcgattaaagtgaaatcagaatttgcagaaatcacaattcaaggggtcatcattgctaaacgtcacattcacatgagcctacgagatgctgctaaattcggcgttaaatatggtgacaatgtacaagtggcaattgaatcagaaggtcgtcgaacaatttttgatgatgttttagcacggccacgtgaagactttgttttggaaatgcatattgatacggatgaagctaacgctgcaaatatccaagctaacactgttgcacggatcgttgaagcaaaacctgaacaataatcattgcagagtgcaagtaaggaggcgcgttgatgagccaaattgatttggatcagctgatcaagacggtgacgcagatattagcgcaacgcgctgaacaggcgctaaccgttagtattgaagatgattgtcccgatgagtcagtctttctaacccatcaaacggtgatattagagcatgtcgatgttttgtttctcaaaacattggtcacgctagataccactgctaatgattgggcacaatggtttcaaaagggctttaattatgggattaattttgaaattcgaatggggtttgccgacgtaaatctcattccttggcaattgttaaccaaatggcccgttcaattgattagtaaggatcaacagccaattgttgtcattgataaaccatatattacgtatgccgatgtcatgtttatgaaacagaccaatatattagtaaaattaagaagacagaagttgacggcgcttgctgccgatgctttggccaagagtcagatacagattattgaaaggattgacagtcgatgtatatgggagtagttgtgggaagtgtcgtcgccacacaaaagtcaacgtcgttagttggaaagaagttaatgattattcaaccgattaatagcgaacgacaaccagtcagatttgaagaggttgcaacagacacagttggcgcgggaattggcgaaaccattctctttgtgagaggggcagcagctcaccgaagctttcaacaaactgctagatccgatcaagatgtaacggatgcttcaattgtggcaattgtggatagatttgataagtaggtgagcttaaatggcaatttataccaaaacaggtgataaaggaacgaccgcgctttttgacggtcgccgtgttaaaaaattcgatgatcgcgtggaagcctacggaacaattgatgaatgtaacagccaactgagtgttgcgcaaaagttctgtaagattccacgaaatatcgaactacttgagacgattcaaaataacatgttcatcgttgccggtgagctagcaactgataatacggataaattttacggtaagagtcatcaggtgacagaagatgacgtccatcttttagagacaacaatcgattattatactgataaattgccggtgattcatgaatttattttacccggcaaaagtattgctggtgctcatttgcacctttgtcgttcggtttgtcggcgagctgagcggttaattgtgcgcttaaatgaagacaagccggttagacctggattgttgaagtacgtcaaccgtctttcggacttgttatatatcttagcgcgagcagaagatgattttgaccaaaaagaaaaattagttgatgaagttgttcggcggtatcaagaaaaggtgggtaaataacgatgacaattgagaatattttaaccgagattcaacaggcgattactaaccaatctgggcaagcaatatttagtcgtagcttcatccaatcagcctttgatgcgggtgaagcgcgggcaaacgaactcggtgttggggtgacgatgtgtgtgacggacgcaaatgcaaatcctatcatgctctatcacatgcctaatgcaaatcttgttagccttgaattagcgcctaaaaaagcttggtcggcaattgcaatgaagatgccaactaaagaaatcagtgaacaagtacaaccaggcgcaccattgtatgatatgtcgacaatgttaacgggtaaattagtcacatttgcagggggcataccacttaccacccacgatactattattggtggtgtaggggttagtggtggatccgttgaagaagatcaaagtatttgtcaaacgattgtgacaaaaattttagagggagttcaatagaatggataatttagaagaaaaaatcagaaaaatccttgaagaagaattaagctcaagtttgtctgactcaacatccaaaccaagtaccgttggcagtaaaggccataacggtatctttagtaatgtggatgacgcaattgaggctgctaaagctgcttgggaagattatgttgatcaaccaattgaaatgcgtaacaaagtggttgaagctattaaagaagggttccgcccacatatcgaatggatggctaaacaaattaaagaagaaactggtatgggaacagttgatgcaaaaatcgctaaattaaataatgcattatacaatacgcccggcacagaaatcttacaaccagatgctgaaaccggtgatggtgggttaatcatgtacgaatatgcaccatatggtgttatcggtgctgttggtccaagtactaatccagctgaaaccgtaattgcaaacgggattatgatgttagctgctgggaataccgtcttctttggtgctcatcctggtgctaaaaacattactcgctggacaatcgaaaaattaaacgaattcgtttatgaagcaactggtcttcaaaatttgatggtcagtcttgatcaaccaagtatcgaatctgttcaacaaatgatgtcgcatccagatattgctttattagctgttactggtggtcctgctgttgttcaccaagcaatgacaagtggcaaaaaagcaattggtgctggtgcgggtaatcctcctgcaatggttgatgcaacagctgatatttcactagcagcccacaatatcgttgattcagcttcgtttgataatgatattttatgtactgctgaaaaagaagttattacagaacaatcaatcaaagatgaattgattacgaagatgcaacaagaaggtgctttcttacttaagaacaaacaagacatcgatcgtttagtgaagatgacgattaaagacaatggcgatcctgatcgtaaattcgttgggaaagatgcaacattcatcttagaccaagcaaacatttcttacacaggtcacccatcagttatcattcttgaagctagtgtagaccatccattcacaatgactgaaatgttaatgccaattgtgccagttgttagttgtccagattttgatagcgtattgaaggctgcattaattgcagaacaaggctatcaccacacagcttcaattcactcccgagacttagttcaaattaaccgtgctgctcacaagatgaacacatcgattttcgttgttaacggtcctacttattcaggaacaggtgttggctttacaggtgcttcggccttaacaattgcaacaccaactggtgaagggacaaccaccgctaaatcctttacacgtcggagaagattgaattcaccacaaggcttttcacttagatagtgaggcacaagttaaggaggaattggttgtatgtcagactttcatgtaggtacgcagatatattcaggacaaacagctttggatcaacttgatgacgttcaaaaccaacagattatgcttgtgtgtgatccgtttttgaatgacagtcaagaattacaaaaaattaaaaatcattttaatcatagcaatacgattgaagtcttcgcggatgtgaaacctaacccaccattggaaaatatcgaagccggtgtaacggtttttagtacattcaaaccaaccgtgatggttgctgttggtggtgggtcagccattgacacggctaaagccattcgtttctttggcgaaaagcttgatcagcaaaaaattgcttgttttatcgctattccaaccactagtgggactggttcggaagttaccaacactgcagttgtttctgatgaaaagaacaacgccaaatttccaattatcgaagattatttaattccagatatcgcgctattatacccagagttagtaatgagtgcgcctaaatcagtttctgcattttcagggttagatgttttaacccatgcgttggaagctttagtcgcaaaagatgctaatctcttcacagatgccctagctgaaaaagtcatcgatgtgattacacataacttgacgacgatttatcaacaaccggacaactatgaagtgcgagaattggttcatcaagcatcaagtgcagctggaattgcgtttaatcaagcaggtttggggattacccatgcgattgcgcatcaattaggcgcaatgttccatgtgccacacggcttagcttgtgcaatgactttaccatacgttgttgaatataatgcccaagatccaaaagcacgggcaaaatatgcagccgccgcacgtaaagcaggtttaattagtggcagcacaagtgatcaagttgccgttaagaagattattcatcaaatcaaagcaatgatgcgggcaatgaattgtcctcaatcactcgttaaattcggtgtaaaagcagcagatgcaaatgaaatggttgatcggattattgaaggtgctaagggggatgggactttcccaggaaacccaattgtgccagatgatcaagcattagcacttatttataagaaagttattggtaattaattagattaccaatcgatagaggagtttgacaatggtcgcaaaaattttatcaattaactcgggtagttcatcactcaagtttaaattatatttaatgcctgcagaagttgtcgttgcaagtggtcaggttgagcggattagtcaagcaaaagcccactttacaatgaagacagaagccggtaaggttgatgaagacgtccaagctaagagtcatgatcaagctgtttcattagtgattgatcaactattggcgcatcaagttattaaagaaatgacggaaatcagcggtgtaggtcatcgtatttcaaatggcggtgcctactacagtcaagcagttgtcattgatgagttggtagaacaacgaattgatgaattatccgcattgtcaccattgcataatccagtcaatttattaggaattcgtgcgtttaaaaaattgcttcctcaagcaatgcaagttgcagttttcgatacagcttttaacgcaacgattccgcaagctaatgcactgtacgctattccctatgactactacgaaaaatatggcattcgtaaatatggattccatggacctagtcatcaatatattacggaacaagtgcaagagagatttccaacgatgagtcataagattattagttgtcatctcggtagtggggctagcatttcagctattaaggatgggcaaacaattgataattccatgggattcaccccattggctggcttgatgatggggacgcgttctggcgatttggatccacaaatacttcctttcttgcaggaacatgagggactagatattcaggaaataaagaatttgttgaatgctaaatccggattattagggatttcagggtattcaaatgatattcgagatttggaaaaggcacaaaaagaaggacatcaacgagctgcattggcgttagcaatgtttattcatcggattcaaacttatatcggtgcttatgctgctgagttgaacggtgttgaaaccattgtttttactgcaggaattggtgagcatgatagctacatccggagtaagattatgcaacagtttgcttacttaggtgtacgaattgatgaaacgcaaaatcaagcaaatgaattagtgattagtcaacgagatagtgcaattaatgtacttgttatcccgactgatgaagaaattgtgattgctcgggatacgtatcagcatttttcgcattgaatagtaacaccagaaaggagtaaaaagatgacgaatcaattaaaacgggtgattcaagaatcggtgccgggcaaacaaattaccttgtcgcatatcatcgctaatcctgaaacagctattttagagagtattggtattgaacggcgccagatttcattgggaattatgacaattacaccacctgaagcagcagcaattgtttcggatgttgctactaaggctggtgcagttaatattgaattcattgaccggtttagtggttcactagtcctatctggtgctgttgatgatattgaatcagcgataatcgctggctgtggttttttacgagatcaattagggtttacgatccctgaaataacaagatcgtaattaagtactattacaaaagaaggaaactggtgtgaacccagtgctgttcccgcaactgtaaacgatgcaaaatcgtgagtcagatacttccatagatttactttttcgggataaaaaagtgagagtcgtactgttttaatgggtgcactctttagtgtgcccattttttgaaatcagctaaacagtattaaatgaggtgtattagtatgaaaaaagcgttattagttggcgcagttggttgtggtaagacaacatttcgacaacggatatttggacagaaacaaacgtatgataagacacaagctattgaattctttgatagtttaattgatacgccaggcgaatttacagaacatcgacgtctttattcagctttaaatgtgacggcaaaccaggctgatgtcattgttatgatgcagagtgtgaaggataaacgacaaatattttcaccaggtttttcatatatgttttataaacccgctgttggggtaatcactaaaacggatttggcagaatctcaggaagatttggattatgttgaaaagcagctaaagctagctggtgctgagcagatttttacgatttcgtctaagactaatcagggtgttgatacgttaataaaatatttagagtgatggtggttgaatgatagatgaacatcaaattatgcaaaatgtgacggcttggattattgagtgtgcggactacgctagaagtaatctggggaagattgcacatatcgcacaaaaaagtggagaatacgatttagtaacaaatttagataccgacattgaagtgaaaattgaagcgcagatacataagcattatccggaagcttcaattattggtgaggaagcaacagtcaaaaatattcatcaacccacgggactaacgtttttcatagatccaatcgatgggacattgaacttggttaaaaagcatgactgttttgctatcatgattggggtttacgacggagagcgaccagtctgtggtgccattatggatgtgatgaaagagcaactttattggggtggcccgaatatcggtgttttttgtaacgatcgtcgtttaccagtaccaactgacgttgccttgaaagatggtttagttggtgtttcatggcggcagtttttaggcaatcggtttaatgagattaagatagctcaaaatagtgccggaatacgtgtgatgggtagcgctgggttagaatttatagagttgatgaatgggaagcacattgcgtatcttgcaacgctgaatccatgggattttgcggctggtcggatactagccgaaacattggggattaaggttcgtgcagccaatggtaatcaattaaatcgatttaagacgagtcacttgattgcgggaactccggcggcatatcaccggattaagatgttacagcaattttaaattggtaattattggattaaaaaaggattggggatagttataatgaagaaaaatcacagaatatatacagttttgtgcgccggagtgttattaacaacgccgattttaacggctgttagtggcgtgcaagcagcaacaacgttccaagcagagagcagtcaagtagtttcaagctcagcggtatcagcgagttcagttgaaagtagtcagagtcaatcaagtagtcagacttccagcgtagcaccgacacaatcattacaaccaacgacggaagctgataaaccagaaattaatagcgcggaaaaagttcaagtagcacctaaagctgctttaaatatggattatcaaaaagcaattagtgctgctattgatcatattacaagcactaacggatcaggcccatggcaagcgttagctttcaaacaatctgggatttcgatgacagacgcacaacgccaatcgtttattaaaactattgggaacgatgttgatcaaatggctgcagaggggcgctattcagcaactgatgcggaacgctcagtaattggattaacagcacttggtgaagacccaacgaacttccacggtgtgaacttgattcaaaaaacgattgaagcctcaacagctaaatatgttgggattaatggtcaaatatacggcattattgctttgagtacgaaagattatggtgaagaagcaaataaaaccattactacattaattcaagcagtgttacaaaaacaaaatgttgataagggctgggcactctttgggactgatagcgatgttgatattaccgggatggcaatgacggcccttggtatgcaccgagatgttactggagtgcaaccagcacttgataaagccgtttcaatgttaaaagacaaggcatttcaaaaggcaacaggtgggttcttcataccaagttctttctctaaagtagagaattcaaatagtatttcacaagctgttatgggcttaatggctgccggtgttgatcctgccaaagcatttgttggagataacggtgtaaatccaatttcaagattattagcctatcaaagaactgatggtgaattccgttggcaatttgacaatgatagtggtgcgcttgcaatggcaacggaacaagcgacatatgcactggatcaatacgaatttttcctaaatgggaaaggctcaatttacaattttggtgggagtacaaccacggatccaaccgacccagtcgatccaactaatccgactaacccggttgatccaactaatccgactaacccggttgatccaactgatccgacagtaccaacagatgaaaatagtttaagtgttcaaaaaagcttagatttaagtaagacagcagttaaatcattagttgaaagtgaaattgatgatgaaaacttcctcggatcggatattattttcggtgcaggtcggacgggtcaattatcacgcacacagattaaacaattgaatgacaaattgatcgaacagtctaaagcagggaatatcactaaaccaaacgatttagcacgtgttattttgaatttacaagccatggggattgacccaacaaactttgatggccgtaatttggccaatgaactttatgaatcaaaaacagcaacaaacatgggttcttacatggatgcaacaattttattagcgttggtcagtggacattatcaagcacctaaagatgctaagtttactgtttcagatttagtagcttctctagtaaaagacggtcaaaacatgggtaatgacggctggggttacgaaaaagatggtgtcaagactaaagatgtggatacaacagctgtgggtatgttagcgttgaagacagcattattggcaaatgatacttaccaactgaatgatattctagttagccaagcaaatacattactcacgaatgcacaagaatttattgaatcatcagcaacacttgacggtggttatggtattaacggtttcagtccaagtaatactaatagtacggcaatgggacttgcggctttagcaacgaacggtgttgatacaactaaagtattggaatgtaaaaaaggatctgcactttcttcattactaagtttccaaaatgaagatggtagttttaaaacagattattcagtttcattggcaactggtcaagcattacttggtttaaaagcttatcaagaatatgttgctaaaaaagggagtctttatgattttgttaagaacccggtcaataagtatgtggaatatgctgacgttacagttcaagcagtcgatcaagatggtaaagttctgaaaacaacaactgttgctaaccaagaagtaggtaagaaaataacagttaaagcagatcaagtagcggttgatggttacgacttgaaagatgacgcaaccaaagacgttacagttgggaaaaagggtacaatcgttaaatttatttataacaaacatgttgcgccaattgttcaatatgctgacgttacagttcaagcaatcgatcaagatggtaaagtattgaaaagtgtaacggttaaacatcaagaagtaggtaagaaaataacagttaaagcaggtcaagtagcagttaatggttacgacttgaaagacgaagcaactaaagatattacggttgaaaaggcaggtaaaacggttaaatttgcttacgctaaacatacaactgtagtgacaccaacgactgaatatgctgacgttacagttcaagtagttgatccaatggggaaagtgcttaaaacagttaagatgagccatcaagaagttggtcaaataatcactgtcaaagctagccaattattagtgagtggatatgatttgaaagatgatgcgactaagactctaacagttgcaaaagatgggagtacaattagtttcaaatacgttaaacaagcaatcttagatggcgaccaagattcatcagacacgaaaacaccaagttctaatgacagaacaagtaatggcactggcgaagacaacgcagaaacaacattaccacagacaggtgttaaaacagccttaatgagtattacggtaggattagttatggttattagtgcgctcggcgtgtggtttaagaagtctacaaagaaagcttagggggctttagaatgtcaaaaaaaagaattatcacaattgtcacgagcttattaattatttgtggtattggctatgggacttatgcaagtgttagccaaggttcagaaacaagtcaagttgccaaaactagttcaagccatgctactaaaggaactgccaaatctgaggttgttggattagatggtaaggtaaagcccaagaaatcaaagaagcatagtgcggaaacaaaagtagaaagtaaagaagcacaaaattctagcaaggcagcaagtacaaagaaagtagaagctaagaaagcggagtctcaaaaagtagaagccacaaaggcagaagctcaaaaagcgcaagtagagagccaagcggcatctggttctgcaccagcagactctcaaggccaaaaaagtcaggctacacaggctggacaaaccgctaatgttaataaacctgctgatccagcaccagcgcctcaaccggttgctaagactgtgacactaagtgtttatggccctattagtgaggggaaccataaatggcgtaatgatgatagtgttgaaatcaaagatggtgacatggtgattgatgtcttgaaacgtgacttagcaagtaaaggaatggccctttcatataaggggacaggagctactgtttatgtaagaggtattaatgggatatttgaatttgatcgtggcggccagagtggctggttataccgggtaaacggtgtatttccagatcattcttgtgggaattaccctgtaaaaaatggtgatgtcattgactggatgtatacagaagatttgggacatgatcgaaatgcacctcagggataaaggatgtaatgacacagtctcatacagcaggtgaaaattaacagtactgatgtgtagtcattagtgcactcggcggatttaaaaaagcttagaggggatttaacatgataaagaaaaaaatcgttgtaatggtaacaagcttattaatcgtatgtggaattggttatgggaactacatcggtgttagtcaggggtcaacgacaactcaaactgctaaagtgagctccaaatatactgtaaaaaaagtggctcaaacaataactaggtcaacagatgttacttcagatagcaaaataactaaaaatgtaaaagcaccaatggtagacgaccataccaatgctaaagtaacgagtaaaaaggcaactgctaaggcatcaacaaaagaagattcgacggtagcagttgaagcaactaacaaggaagctgagagtattgaaacaacaccaacgaatccagcaccaacattagataatgataatgcgtcaaatcaagtttcaaatgttgtagatgctgatacagaagtagtaaattctatgccagcacctactacaccgcaagttgaagaagttaaacttagcatttatggaccgattagtgatggtaatcaaaaatggttaaataacgacgttgtttcaatgacagatggtgaatcagtctatgatgttttaaaacatgatttagatagtaaagggataaaattatcaaagagtggcgttggttcaacaatttatgttagaggaatcaatagtatgtttgaatttgataagggtccacttagtggttggttataccgtgtcaatggtgtattccctgatcattcctgtggcgattactatgttaagagtggagatgttattgattggatgtatacggaagatctcgggcacgatcgcaacgcgcctcagggttaaaatcgcaactggtctttgatcaattaaatccaatcgtcatctttgcgtattacgtgattgcaattgcgttctcaatggtttttattcatccgatttttcttgtaagtgaattgctgatgatgattgcagtgaacttgcttgcgaaaaaccagaagaaaacactggggacattgcagggtgcattgttcatgatgctctttatcgtcgtgatgaatcctattatgaataatcatggggcgcacgtgattgcgacgtttggtgggacggtgatcacagcagaggctgtcacgtacggttttttaatggcgctttcgctggcgatcttaatgctagtgtttgtttcctataatcagagtatgacgaatcataagttcttatatttatttgtgcggatttcaccgcaactaactttattaacgatgattacgatgcggtttgtcccactatttattcggcggtttaccaatatcaagaatgtccaaagaacacgtggtgtgcagatggaaacggggagtgttagagcccgatcacatgccgggatgcgtttgatggaagtattattgattaattcattggttgacgcactacaaacggctgattcaatgacggcccgtggttatgggtcacagaagcgaacgagttatcaacgttatcgatttacccaacgggatggttgggtattggcaagtcttgtagcaggcagtgcactttgtttttattttgctaaacaggggattggccgcttagcgatttatccaatacttggctcgattcatttgaatcaaattggttggctatgttttgtgttagtcttattaattgatagtttgccgctattactagaaggatgggaatatttatggtggacattgcgcaaataaaacaatttaattttcagtatgcattagcaacccaacaaaatctgaaagacatcaatttaaccgttcagacgggtgacttcattacgttagctgggaactcgggtagcgggaagaccaccttattgcgccaactcaaaaaagaactctggcccgttggtaaacggtcgggtgagattattttcgagggccaaccgttagctgatttatcgcaagggttaagtgcgcagaagattgggatggtctttcaaaatccggataaccaattagtgatggatacggtcattcaggaactcgctttttcactcgagaatattggtgaaaagagtgcgaatattcaaaaacgaattgccgaattagtcagctttttaggtttccaagatttgctgtatgcttccgtgcatgatttatctggtggccaaaaacaactggtcaacctagcgtcggttttgattttacagccggatcttttactgttggatgaaccaacagcgcaactcgatcccattgcgaccaaagaatttattagtttattgcaacgggtacatgacgaactcggcatcaccgtgattatcagtgaacaccagttggatgatattttaccgctctctaatcaactttggttgatggatggcggtgagataacgtatcaaggaccggttgctggtggattagcagcaatttgggcgcaaccggcattgcgtgaattcgtcccagatgtgccacacgtctttttacaaaatgagttgattgcaccagctgatattgcggcattaccattgaccgttgtcagtggcaagcaattgattgagcggcgacaatggcagttaacacatactaaacgtgaaatagccacgaacgaccaatcaacaattctgcaggcgaaacatgtgagttttcagtatgaaaaaaatgacccttatgttttagatcagctcaatctagaggttcataccggcgattggttagcgattgttggtaaaaatgggactggtaagtcaacgttgttgaaacttttgattggtttattacaaccgcgccatggtgaaatcaagttacaaggtaagaagatcggtaagtgggcgcaagctgaacttttcaaaacagtgggttatctctcacaaacaccgagcgatcatttcagttatgatagtgtccgtcaagaatttatcgaacgggcgcggcagttaaaacgcgcaacaccagaacaagtggcagaagagatgctagcaaagctcggtcttcaaacccttgctgaacgtaacccgcaagatgccagtggcggcgagcaacaattgattgcactcgggattgtattgctagcgcagccgcagttactcttgttggatgagccaacaaagggccttgatccgattcgcaaacgggcgttgggtgaattgttgacgcgtttacaagcggaaggcttaacgttgattatggcaagtcacgatatggcctttagtgcccggtttgctagtcagtgtgccttattattcgatgggacgattgtatcggaggaagaaccttatgcctttttcgcgcataacttcttctatacgacaaccatcaaccgaatgttacgcagtcaattgcccgaagccctgaattgggaagaggtgcacgcatgaaagctttaaggaatagttggaccacgtttggattggctttcttgattatggcgattttcatgttgtttatcgtcactttaaaaggacagcattttctaatcttcagttttatctgtttgattgccagtatgctgccattttattggcggtttgaaacccgggatattcgcgcccgtgaaattattttcatcgcggttttagcggcgattgcggcagtcactcgggtaccatttgcaccattgcccagtgttcagccaactagttttgtgattatcgtgtcggcattagtccttggtccagaatcgggttttattgtcggttcgaccgctgcgattgtctcgaatatgtttttgggacaagggccatggaccccatggcaaatgttttgctggggcatgatgggcgttacggcaggcttaattagtcgccatcagtgggcacagaataaatacttgctctgtatttttgggtttgtctggggctttatttttgggtggattatgaatatgtggtattttgtcgcatacgtcaatccactgacgattaagacttttattgcagcctatgtcgcgagtttctattttgacttggcccatgctttatcaaatgtcttttttattttcttcttttatcagtcgtggtaccgaatcatcagtcgctttaaagtgaagtatggtttgttggcgacggaagatgagctataaaattgagccctcaccaaagtggtgggggctttttttaacggacatcatttcatacttgaaagttcacaatttggtcacaactgcttggtattctataaatatcagataagcatctcccaagtaagtgaatctgagcaagttaattttatgagacaattcctccctaaagaagtgtcttagcaacacccaatgagttatagtttaacggtagaaccaatcatctaaattgaaattcctcccaagaaaatcaaaagcgattggctattaaaagcgaattgtaaaatgaatgattgatgtgggttcaatccccgctaactcgatgactgttgtgttaaaaaagccgcaaccaatttggttgcggcttttttgcgtttagtagaccaatccctgtttaccagtagcatggccagttaacagtttattggtaattgtttgaagattagcgaccgttaagcccgtgtagtgggcggtggtgattggatgcagaatccgcgcatcgattagccgcgcaatttgttggagaatcgccccttgactagtggtttggaattgatagtccgttttagtgaacatgtactcaaatgaaaatgaggctgatttaggcttaagcggtgcgagatcaagtggatgcgtattgccaacaatcgtaccgacttgtccaaacggtttaatcagccgtgcgacctcttggagatagctttcaatatcataaaggaccgcgatggcatcaaaggtgttatccggaagactggctaagttgtctaagctgctaggtgaatgataatccagcgggtgatcaactccgtttgtttttagccagtcgaaatgagtgagactgcttgtggcagtgacggtgaatccggcccacttggcgagttgactgagaattgatccaaccccaccggcaccattgataatcaatagttgtttgccacgattggcattttgttcagcggtaaaaccaagcttttcaaaaagtaattcataggcggttaacgaaacaagcggtaagccggcaatctccgcggcactgattgtactaggcgcaagcgcacaaatcgcggccggaacacattgatagtgttggaaactgccatcgatctgggtactgccggcatagaagacaacatcgccaggttgaaagttggtcacagtggcgccgaccgcttgcacggtaccatacccgtcatagcccaaaatggttgtggtgctagctcgtcttttaaggtcgacagggttgacgctacttgccctgactttgatcagtagctcttcaggtttaggcgtagggatttcaccagacactgcgtgccaattatgttcggtatcaagttggatttggtgattagtggtcatgatgacgtcatcctttctgaataaaatggttagtctaagcctactgctaatcaccgcataatacaaaaaaagacgcccaattaagaacgtcttgagttcatttaaattgcttcaacagtaacttcttcagttggttcatctgcagaagttgtctgtaaaaattgatcgcctgcaagatctttgtagaatgccatataagttgcattcttatatggcgttaaccagaaatagccaatgccaagtgagaggccagctaaaatatcccaacctaagaagcttagttgtaagacgaaaaaccggaatttatgcccattcattaactcacgactcttagtgatacaatctaaaaagctaacgtcagcttgtggatcgttatctgttaagtccttgaagatataagaagcttgagaataagcgtagcctttaatgatccccggaataatgaataacaatgcccaaaggaatgtaaataagctagctaaaattcgaattagaaaagcgcccaagaaataacgttttgagaagacactgaaagctcctttgagtgaactaaaatcagcatctttcgaacggagccaatctaagaaagtaaaattaatcccaagtgtaatgagccccaaaatgaaacttggaatttgaccagcaaaactactaccagacgaatggcccgaaaaagattcattggcagccattgatgggtcggtgtttgcgaagatggcaatcatggccatcaagactgctccgacaataatcaccccaataattgatagcagagtggggatgatgttcaacgtaacggcctttccccaatgaccagcaaataatgacttaacttcttttttaagtgaagcgcgtgattgatactctctttccatgataattcctcccttactacgtagataaattatactattaattaatggctgaaatcaatttatttttaagtatctttgaaaggattgttggggattagttgttgaatgcactggtacatcaggcattctataaataatagcacatcataattaaatagtgtaaaatataaaattagctattttggttaaggagatgtatagaatgaataagggtcgattagaagcatttagcgatgctgtcatcgcgattattgtcaccattatgatcttggaatttaaaacgccagaaacaccggaaattaaggcacttttggaaaatggtccctacttttttgcgtatatcattacgtacgttttcgtaggggttgcttggtataatcattactatatgttttcgctgacgaaacgaggaacaaagcgtatttattggctgaataatatttggttattatccatgtcatttttacccgttgcaacggcttggacggggcggttcatcaatgaacgcggtccggaatatttttactacgtggttcatctgatttggttattggcctacttcttcttgagtgatgcattggcgaacgccaatcgtgaagtcgcccctgagcggtatcaaaaaattaaagccatgccgatctatagcacgattactagaccttatttctgggtgattcaagtgattctattagtcgctatttatttcttcccacccatcgaattaattttcgtaagcgccaaatttgtttaaagcagacagatgttttaaaagtcatgcccgcaaaagttgttaagcaacttacgacaacggaaattcgagcaattcattatgcggtcatgcagactgctggaccatcaaccattggcgggttacaaggtatcgggcacgcttatcgggccgtcgtgacggttgatacaaagcaatccgtagcaccatactatattaccaaccaggatttttttcagtaggcaaaagttctgaaagcttatgcacaacaggaacacgttcaatttgatgatcagatggctttgctgccttattttatgacgcatgacacaactgactgttttaattatttggaggtacattacagcgaattagcggaaaaagttgggtttccagcagaaagcgcaggacaggcggtttatcgatggtagatgaaacagcaaaaaacaactttgaaacggcgacagatggggttcaggcttatcacaattattttggcacgccaacgcacgatgatcgtatttggtttgaactcttaacagttggggtcttccaagtggggttgagctggaaagtagctgcaagtaaaataccagttctgcggcaacaaatggcggggatggtgattgatcaagtcgcacaatttgatgaaatggatgttgaacgcctgcaaaaagaaccagatatgattcgtaatacgcgtaagattcgggcaacgattcaaaatgcgcgggcaattcaagccatccaaactgaatatggcagtttttcagcgtatttgtgggtgtttgttgatggtcagccgcaattgcttgattcacaaatggctggcgtgtccgataaatcagcgccgatcagtacgcaacttgcgaaagaattaaagaagcaccagtttaaatttgttggaccggtggtaacgcatttgtttatgcttgcaggtggtttgattcaaatcatcgatgaagactaatgcctaaaaggtaaaccaaattggtttacctttttttgttggctgatgttagaaaatctgacatcaaatattgaccgttttaaaggcgactggtaagataaaacgcaagtgaggtgaaatggatggctgaaaaacacttaaggcgcaacttagcagttttaccaattggtacggtaatgaaattgacgggacaaactgcgcgtcaaattcgttattatgaagcacaggcgcttgtttttcctgaacggacaacgggccatcaacggttgttttcgttgaacgatgttgatcgtttgttggaaatcaaggattacctggctgaaggcaccacgatggcgcagattcgccagatttatcagaagaaggcggatcggcagcgtgataaacaattatcagacaaaaaagcgcggcggttattggccaatgaattattatcggtcggcggcttagttggacaacagtcaaccatttcacaatcatctaaattatattaaggggcgacggattaatggcacgtaaagtattgacagcagaagcaatcaagcaattagtggatcaagaaaacgttaagttcttacgtttaatgtttacggatatcaacgggattatcaagaatgtagaagtgccaattagtcaattagataaagttttaagtaacaaaatgatgtttgacggttcttcaatcgacggttttgtccggattgaagaaagtgatatgtatttgcggcctgatttaagtacatggctcattttcccatgggaagctgaacatgggaaagtcgcgcggttaatctgttctgtctataccgcagatggagaaccattcttaggcgatccacggaataatttgaagaaattagtgcgcgaaatgcaagataaagggttcaaagactttaacattggacctgaaccagaatttttcctctttaaattagatgaatacggcaaaccaacgttgaaactcaacgaccaaggtggctactttgattttgcccccgttgatttaggcgaaaactgtcggcgtgatattgttttggaacttgaaaagatgggctttgaagttgaagctagtcatcacgaagtcgcacccggacaacacgaaatcgattttaaatacgctgatgcagtcgatgcagcggataacatccaaacctttaaattagtcgttaaaacaatcgctcggaaacatggattacatgcaaccttcatgccaaaaccattacacggtgtcaacggctctgggatgcacattaatatgtcactctttaatcaagatggtacgaatgccttctacgatgaaaaaggcacagaacaactttccgaaacggcttatcatttcttagctggcttattgcaacacgcacgtgccatcacggcaatcaacaacccaacagttaactcttacaaacgattagtccctggttttgaggcaccggtttatgttgcatggtctggtcataaccggtcaccattgattcgggtcccacaatcacgcgggttatcaacgcgtctcgaactacggagtgttgatccaagtgccaatccttatttagcaatcgggtcgattttggcagccggtttatctggcttagatcaagggctcttgcctgatgctggtgtggatcgcaacatctacagcatggacgaaacagaacggaaggaaaatcacatcactgacctaccatccacattgcacaatgcattgaaggaactaaccaaggatgagattatcaaagattcaatggggtcttatctctatcagagcttcatggattctaaatcattggaatgggcagcttatcgtcaacaagtttccgaatgggaacgcgaacaatatttggaactctattagtcgcaatttacgccatgtttttgtacaattaaactttagaaatagaaagttggcagaatatgaaaacattggtgattatcagccatcccgaaattgagacgtcgatggtccaaaactttttaaaagcgagtgcagcaccactggaagccatcacttggcaccacttagatgcgcttgagacgttagatgtggctgctgaacaagcattattacgcaaccatgagcggattatttttcaatttccgctctattggtatactgctccagcgagcttaaaaatgtggttggacaccgttttaacggggcaatttgcctttaatggccgccaaccattagccgggaaaacactcggggttgtcgtttcaactggtacggcggctaaacattttcaagctggcggcagtgaacaagcaacgctgtctgaaattttgcgcccatatgaattggtggctcgtaagctagggatgacctatttaccaccacttgcgattcatcaattgggttattggcaagaaactgataaacaatgcttggtcatcgattatcaacggtatttgacgcaatccgagttcaattttgatcagcaattagcgtggtttgaagcgatgctgactaaaaaggctgctgaagccacatcgcctgaagcgcaacaacgtttaatacttttaagcgaacaattcgccgacaaacgatcggaattaaccgatttgaattggcaagtccaactgattcgcgaagaagagggggaaggctaatggattggttaacagaacaaattcaactacaaaaagaacaagccacaatgtatgaagagcaagctttttatacggcgcttcaacaaacgagtgatgaactggcattacggattgaacaacgccaaggtgaacttgatggtcgaatctggaatgcaacgaattggtaaactaatgcaaaataaaaaacgccgcgacgaaagtcggggcgttttttgtgtaattcgattaatagcgtttgattaatgtatcgaaagcatcaacgattgcttggaagaattttagtgtatctgggtttgtgatttcttggttgtcgtctaataagttcatgacattgccgatataagcttctggttgttgaaccattggcatgttcaagaaaacaagtgattgacgtaagtggtggttagcaccgaaaccactgattgcaccaggtgaaacgctgacgatttcagctggtttgttatcccagatgcttgcaccataaggacgtgaaccaacgtctaaagcatttttcaatacggctggtactgaacggttgtattctggtgtgacgaataaaacggcgtccattgtcttcattttatttctgaaagttgtgtaagcttctggtacttgatctaaatcatcataatcttggttgtacaatggtaagtcaccaatttcaacaatttctagattataatctgatgggaataatggcatcaatgatttagcaactgatttgctaaatgaatctttccgtaaactaccaattaaaactgcgatattttttgtcatagtgaaacctccaattattttacttattattagtaagtaactttagtatagcacgttcccctgaaaaggcaaccacttttatttactaatttaagcatggcgaattagtgaagcttttagcaaataatatggtcggtcatcgattggcattggcaagctataaatcgtataatagcagtaagtagaacaaagatgggaaatgaataatggaaattaaatggcacgtcaatcaaccacaatctgttaaacaattcttgctagcaagtggtgtcagtcaacgattgtacgccaaaattaaggcgttaggccaaccgattctagtaaacggtaaaaaaagtgcgcctagtgatcaggtacaatgcggcgatgtggtcacattgcagttaccagctgaaccggccgatgaatcagttgctgttagtcacgaaccaatcactatttgttatgagaacgagtattggttggtggtcaataaaccagatggcttggcaacgattccgggtcccactaatcaaacggatactttgttgaatcgcattaagggttactggcaagcgcaaggtgcaacagatttagtaccgcatatcattacgcgcttggattttgatacaagtggaattgttttagtcggcaaacaccaaattgcacaaagtctattgcaaccgcagattgaacagcatcaattacaaaaattctatttagcagttgtttcaggaacgggtttaccagcatcaggggatattcgtgaaccgattggacaaatcgaccatcaaccgcggcgtgaggtgttggcggatgggcagtcagcttggacgagttattggcgcttgggtgcatcgggtcagttgacggcggttaaagttcagattcatactgggcggacgcatcagattcgggttcacttcagcgcgttaggccatccattggtgggtgatcagctctatgatgggccgcttgatttagggataacgcgacaagcattgcacgcgtatcgactgcaatttcaagatccattcagtcaacaatcaatctcaattacagcaccgattccagccgatatccaagcgattctacctacagaacgattatcaattgattgattcaaaggaagatgacaaatgaaaaaatggcaatggttactaatttgtatcttgtgtttcggcattggcggggttatcggtcatgtagcgactggtccaacaatggtgccatcgattattaagccagcttcggccaccgcgaaccaacccgttattttcgtaccgggaagtaatggaacggttgaagggtttagtggcacctttgctaaattgaaccgtcaagccacacgccatgttttaaaagtaacggtattaaaaaatggtcacttgaaaaccagtggtcgctttgatcaaaaaacacaacaccccgtgattgtggttgcgtttgaaaacaatgcagatggtgatgaaaacgtctttaaacaatccgaatggtttaaattggcagcaggcaaattagctaaacaataccactttacgtattttggtggggttggttattccaacggtgggcttgtattaacgcggtatgctgagcgtagtggaagtggaccgaagattacgcgattactgacgttgggaacgccatataatggcttgtcggagcacatcactcaggaaacaccgatgttagctgatttaaagagccgccggcaacatttatccaaagacttagtggtctattcagtcggcggcacaattaacgataagaatgatgggattgtcccagtagcgagtgttgcggctggtcggctcatttttcaaaagcaagttgctgattatatgacaatttcggtgagtcagcaccatgcagcccatactgaattgccggataatccaaccgtcatttcactgattcaacaattgatgtttaaataaaaaaaggtgtgtcgcagcaagttgagctgtgacacacctttttaatactattgatcgattgttttcaagagattccgcgtgatgagcattcccatgatgaagattaaaatttctgttaatgggacactcacccaaacaccggttaatccgaaaaggctagaaagaaccaagacgctcgcaatcaaaacgatgtagccccgcatgatggccacgaaaaatgacaatcgaggttgcgcaatggcggtcatgaataagttattgacgatgttcatgcttgagaagaaaaaactaatgaaaattaagggaatgccagctgacgcgtagcgaatcagttgttggttgtgttcatggttaaaaatttcgatgatcggtaatttaagaccaatcaaaacgagatataatcctaccgcaatcccgagtgcggaaagcaaaccgattttgaggctcgttttgacattatcccaatgatgtttcccaaattcgcgactaacgattggctgaaccccgactgcaacaccgttgaatagggatagaccaactagtaagatgttggcgataatgccgtaagcggcgacggcatagttattactgagatggagaataacgatgttaaagacgaaaatgctgaccccagtactcatttcagttaagaaagatgggaaaccgagttgaattgctttgaacgtcggtttaaaacgtaaggttaagtgctgcaaagttagtaaccgttgtgggtgatgccggtgttgtgtcaaaatgagtaggctgacgattggcgaacaaatcgtggccatcgcagcacccatcatgcccatgtgtagggggaacattaagaggtaatcgaagataatgacgaataagctttgtgaaagtgtcgcaatcattgtcaaatgtggattactatcgttacgtacgaaacttaagactaagttattgatgataaataagggactgccaattaaaataattcgtaaataggtcaagcttggggcgagcgtttcatgattggcacccagtaagtagagtagtgggtgaataaaaattaggccgagcgccatgatgatgaggcctaataaaatcccaaaagaaagaacttgagtgaaaatcgagcgactcttttcgggatgcttgctcttgttaattgagaaaatcgtggcgcccccaatcccgagcatcagacctaaaccgttaaataagttaaaaatgggcagatcaatattcaaagcggccaagccaattggtccgactgcgtaagcgataaaatatgtgtccgctaaaatatagatggataagcctaacgagctgaaaacgtcacggatgatgtagcccgttaattcttttttgatatgtggtgagttttccaaaataacactcctattcgattggtagtggggtcgccattaataacgcaataaatgattggattggtgctggcaaattcttccgggcgacaaggtagaattggcgttgatattgttgggacaatggtcgatagggaatttctgggtaatcaagtaaggctgcgctagaaactaatgattggccgataccctgtcttaatagttggataatcatcgcattgcttttgatggtcatcacgttttcgagtggtaaattattttctttgacgtaattcatcgtgtagtgatagacgccagaaccctgttcacgaagtaaccaaggttcattcgggcgacctgctaggaccagttgatcggtctgtagtggcgtccgaatcaagtctttttcggttaatggtttttcaatgaaaccaaagtctagtttgtgctgcgtcaattcttgaacaatctgcgatgagttgagtgtactgatatctaaggcgagtgtttcaagggctggccgatgcgctttaagcagggttggcaataagtagattgcagtggtgtgcgaggcgccaatccggcacggtgtttttggctggccatcttgatgatggagtgcgtgcaaatcttggtcccataaatcaaggagttgttgcgcttgttggtagaagagatcagcactcttagtcggcgtcatctgctggcgcccattgcgttcaaatagtgtgacccccagcgcatcttccaattgtttaatttgcacagaaacggtcggctgcgagagaaaaagcagttgcgcagccgttgtaaaattcttggtttcataaacggttttaaaagttgttaaaattttaaacatatcatcacttctattcgttctcttaataacaactattataaagatttattttattaattgaaagagtttcggtatagtttaagataacaagtgagaaggagtaaagtaatggacaatataacaaaaaaaatacctggctttgcgttatcgttagcgattgcgattgccagttattacatcgctaaattatggttaccaatgttaggtggcgcaacgattgcgctttttgttggcatcatacttggcaatacttggttgcaacaaccggtattagcagccggaactaagttttccgagaaaaaattattggaatattcagtcatgttactgggtgcgacaattacattccaaagtattcaacaaatcggctggcatggtgtgctgtttacagtgttacaaatgagttgtacgattggatttgccatctggtttggccgccggttgcaatttagcgaaggtacctatttattgatggccggtgggaatgccgtttgtggctcgagtgcgattggggcaattgcgcccgtcatcgatgccgataatgaagataccggtattgcgattacattggtaaatctaatggggaccattttgatgttactcttgccagttattggaacgttgatgtgggggcataataatgaactccgtggcgtgttgattggtggaacagtgcagtcagttggtcaagtggttgccagtgcgacgatgattaaccaaggaacggttgtcacagcgactttattcaaaattttacggatcatctgtttggtttttgttgtcagcggttttggttacttacatcaaaagaaacaaagtaaagtcagtgatacaaaactgagcgaacaattattagcgaagaagagtagcttagtgccatggtacgtgattggcttcttattattctgcgtcttaaatagcttacgggttttcccaagccaatttggtgcattatgccatttcttgagtacatggtgtgaaacaacggcgttagcagccattgggctacgcttgaacttaaaggcactcttcagccaaggtaaacgtttattagcatatgccggcggactggtgacagtacaagtagtcctcgcgattttattaattacactattattctagggcgtgtcagcagctaagatgtttctagaaatattgaattattaaaaaatctgccatcaacaattttgttgatggcagatttttttgttattaagcttggtaagtgccgacttgaacggcttgttttaaagtggctggtgtgtgatgtgacttggcgaaaaattcgcttaaatcacgtccggctgttaaacctttaaaatgtttgccgccttgccaaggggcgattgcggaaaggtcataaacgacgccatcaacggcaacgtatgcgggttgaccatcttgaccgttatattgagcgagtgtttcttttgtaaagactttatctgtcatgattaaaaatctccttcgaattgtgaatgggttaccaataatatagcgctagatgcagaagttggcaacgattaagttgtgcactttgaaaatgaataatgttgaggctagcgaattagagaattattcgtgaccttaaatactgttcttcaaataataatttgttaaaataatcatagttgggggggatgaaaatggacaataaaaaagactggttgatgcgacaagttgattcttttgcggaaggaatgggttatttgttatcgaaacaaagtggtaattcacagtcggaggttgtctttccgcaagaaaatgctaaaaaattgccttttcaaaaggaattggcaagtttaattgctgccaacgatactagaggggccgcccaacgattattaaaattacaatacgcaatgcctgaagaacaatttctacagttaggtacatggttgttatcagaaatgaagcaggacagttttcctaatcctttaacccgtgaagcgctgacagacgttttaaatacgattaattaaataattgaacgaaaaaaccaccctaataaataatagggtggttttatttaatattgatggacccgaccagattcgaactggcgacctcctacatgcgaagcaggcgctctcccaactgagctacgggcccaaacgcttacaaaaatattttagcacttttagctaaaatagcaaggcgaattagtgacgggcagatgttctgaggttatttgcttttttgccacctttaatcgtgcgggttttgaagtgggcttgttggctatcaggaacgaacttgaagtgttgcattttcccggcatatggttggccactgaggcgaatcttcaaccaattttgcatggcttcaatcattccagtcagtttttcggcttgttcagaatttgcttgtttttggacttcggttgtaacatcgttagtgagataagccaataatttttgatgataggcaattagttcttctgtgagtggcgcttggttatattgattgaaaagtttttgaacaaaacgcattgcatctttagcgttttgtggttggtaaaagcgatcttgatcagacatagaatttccctctttcttcagagtagtataacgaataatagtgctcgtcacaaccgtgtgctttggtataatagagaaatactagtttttcggaggtcagcaatgtttaaacgtaaaagtgattggttcttagtggctgcactggtgatgatggcgatcttattttacagttcttcaatgacgtatcatgaacaaacatcggtgcctacgttggaacgatttctcaagaatgaaccacttaaggcttggttaagtcaattttcgttccattatgcaggcagtgaacagagtgtaaaagcatctgggtatttcaaatttgtggagtttttcgtgcgaaaaggcgcccattttgggacgtatttcttattggcggcttttagttatttagggctacggccacgcgtaaccggtggttttttagcagttatctttagttggctggcagcaaccgggtatgcggccacggacgaatttcaccaaatgttgactggtgatcggacgccactttttcaagatgtgatgttggacagtgttggcgcattaacggggattgtgattgtttgcgcactacagtggatttttacacaaaaaaagagacgatagcccgactaccattgcttttagcatggtaatttgctatcatagaaaacgacttagtaccagaattctataatcgaaaagaggagttagatatgtcaggacattcaaaatggcataatattcaaggtcgtaaaaacgcacaagatgcaaaacgcggcaagattttccaaaaactatcccgtgagcttttcatggctgcgagaagtggcggtcctgacccaagttctaacgccgcattacgtttaattatggataaagcacgttcagctaacatgcctaaagataatatcaaacgggcaattgataaagctgacggtagcgatggcgcgaactacgatgaaattacttatgaaggctatgcaccaggtggtgttgccgttttagtacacgctttaactgacaataagaaccggacaagttcagacgttcgtgttgcatttactcgtaatggcgggacaatgggtgcttctggctcagttgcttacatgtttgatcgtcgtggttacattgcgattgcacgtgaaggcttagatgttgatgaagatcaaatgtttgaagacattctagaagctggcgcggatgatttacaaactgaagaagacgtgtttgaaatttacacagatcctaaggaattagcaaatgtccgtgatattcttgaaaagaaatacacattggcaaatgctgaattaacaatgattccacaaaatacaacaccggttgatcctgaaaaagcagaacaattccaacggttaattgatgctttggaagacaacgatgatgttcaagaagtttatacagctggcgaactaccagaagaagactaatttgtttgataagtgcgttgcaagtaattgcaacgcactttttttgtgcagaaaattatccggttatttgcgtatctttggttagtcaggaaggagggacgagatgaccgaagtattaacaacccttttgcaaaagtgcgcaacggaaaaagcgcaggatctttattttcgaccactatcgacgggttgggcaattattgaacgcttagcgacaggactaaagccgttacaaaaagttactctgtcagaaggcaatcaatggctcaatcaaatgaagtatcaagcggggatggatatcagtgaaactcggcgtccacagaccggccgttcagcgatcgaggtggcaggcgaattgatttatttacggttggcaaccgtgggggattttttgaatcgggaaagtttagttgttcgtttcatttatcccattgggcagacttatcattgcgacgactcgcagattttaagtcgtttaatgcagttaattcagcaaccaggattattgctatttgccggtccaactggttcagggaagacaacaagtttgtactatcttgcggaacaagtcatgcaagataagatggtggttgcgattgaagatccgatagagattcaacagccagcgttcttacagttacaggtgaatgaagccgcagggttaacctatgcagcattgttgaaaatcagtctgcgattacggcctgataccttaattattggtgagattcgcgacttacagacggcccaacacgcggtttcagcggcgttgagcggtcacttggtactaagtacgattcacgcgcgaagtacaacgggggtgatggaccgtctattagatcttggaattagccactcacaattaaccgcttgtttagcgggtgttgcctatcaatcactagtggtcgaaggccaaaatgtagcggcccactatgagttagcaactgcacaacaattggaggaggctgttcatgaagactaaaaccactgttcaattcaatactgaatttatgttgctgttaggtcgcttactgcaaaatggtttttctttacaacaagcacttgagttcatgccgattgtttttccgacgcaaaagcagtggctgcatcaggtgcaaactgggttagaagcaggaaaacgactagcaccaagcttagcggcggtttcgtttccagcacaccttgttgcacagattgaattgactgagttgcagggaaacttaggcgagtgtttgttacatcttggccaattacagcgaattcaacagaaacggcgtagagagttagttggcgtaattgcctatccctgttttctactcctttttctcggggcgttgattgggatgatgcagatttatctttttccggaaatcgcgcagtttaacccaacaacttcggcgacatcaccattacaactattttttagagtgatggggacattcgttattatggctggtgctctgattagtgtgtattttttccgttggcatcggcgaccgctattacaacgattggcggcggcatttagatggccgttcatcggtaaaacgttgcaggcttactatcagtattgtttattatttgatttagcgacttgcctgaataacggcttaaacttggccgaaatgcatcagcttacacatcgtttggcgaaaacatcgtggcttgtacaattaatgcaacaacttgaaacggctgtccaaaaagggggcacgctattggcgaacttagcggatggcgttttttatccacctgagctgcaattagtgctcgctaagggaagtccgttacaacagatggccaaggaggttgatctgcttgcagtcattaaatacgatgaactgcaacggcaattgaaacagaaggtgaattggctacaaccgctcttgtttatcctaattgggatcatcattatttgtacctatctcagtattttattaccgctatatcatacaatggagggaatttcatgaagaagaaaagaaatgcatttacattgatcgaaatggtcgttgtgctagctgtgatagcaatgttagtcttgttaattgcacctaatttaatgcatcagaaagagacagctgagcaaaaaacggatacggctctagtggcaacgattcaaacacaagttgaattagctgaggatgacggtaaaacggtgtcgagtctagccgatttagcatcaggtgaaaaatatttaaccaataatcaggttaaacaagctgaaaaacgcggcgtaacaattaaggataataaagttgttcaaaatacaaaataaggcgttcactttaatcgagagctgtcttgttttgttcattgttggagtagtcagtttatttgcgttgcaacatattcgagattatcgtgcacggcaggcggagcgtttattttttgaacaatttgaagcgtcttggcatgcgactcgcgaatatgtcgctgttgagccgcataatgtgcacttatcttgggatcaaaccaaccacacgttgcattacacaagtgcggatccacaataccaaagtatggatatcccgattccagaaacattgatgtgcgtcgatccagaaacatggtttaggatccaatttaatcatgactcagctgctagaccgcggtcattgatttgtcggtctaaaattgatgggcaccgttatgaatatcgggtccagatgatgtgggggatgttacatgttaagaagtagaccggcatttctattaatagaacaaatcgtggcgttaagtcttctcctgatgggaggcttgaccttgacaatgagtctacggcagtttaaagcacatcaagttcaacggcggtgtgctgctacagaatatgctgtaatggcaatggctgccaatcgattggcaaatgagcagccgccacgagcacaatggcagttgcaacgggaaacataccaagtcgtcaccaaaaaacaggccatttatgtcacaaataaagcgggtgagcgagttgcacttcaatggtattgttactaaacgctctggatttacactgattgaaatggttgtagctctcgttattctgatattgagcagtcaattaatattggcaaccactaaaacactaacgcacacaacgcaattaacccagatggaacgtcagaatattaattggcacattagtatgattgaacttgatcgttttctggatgacgctcaatttatttcaattgaacaggcgaattatgaacagcaattaaccgtcgctaaagattcgaaacgacgctataccttaacgaaaactaagaaggaactggtggtttcgagtacgaagaatggttatatgcctctgtttgatggggtctcgcggttaaaaatggtgtatcatgaaccttttttagaactcgaagcgcgcttaagcgatgggacagcctatcaacatgaatgttttttggaggcgcaacatgacacgaaaaatacagattaaacgctctgcagtcgcgctcttgaatgcagttttgatgttgagcttggtgacaagtgcgttgttgattgtgacccacagttaccaacagcaacaacagagttacgtcagtttgactaactattaccaaacgcaaatcttgcttaaattaacaaataaagcgcggcaaactcagtcaattcaaggtataaagactaacatcggtaagagtcgtatcgaccagcaacacaagttaatcatcattgagttaaacaatggttatcgaaaacagtttccagatcagaatgaaacagatcaaggataaattttctatttgataaagcgcttactatgatttataattctaggtatacccacctgtattacttgctttgccgttagaataccgatagaatataacaggaatctaatgaatagaggtggctattttgcctaagagtgctgtagaaacgttgtttgatcaactcgatcaaacaacacaattaattgaaaagaatttagaaacaacctatttggatgcactcaccgagaccattgctaatattgcagatggtggccgcgtaaaggttgaagacggcttaccagatgctgccactgttgcacaactagaaccgctttatgcggcggttaatctcaaccaatttgaagcagaagaaattcgccaagcattacagttggcaacgctcaagggtttgcgtcaagttaaagtggaaccaaacaagcaaatgacaccagatgcgatcggctatcttgtagcttatttggcagaggtttttggtggtgctgaccaaatcaagacaattttggacccagttgttggaacggggaacttattggcaaccgtaatcaatcatatccaaaaactaacggggaataccgtgcaaggttttggggttgataatgatgatagtttgttggaaattgcgggcatcagtagtgaattgcagaagcattcaacaacctttttccatcaggatgcgattgaaccgctactggttaaaccagttgatatcgccgttgcggatctaccaattggtttttatccattagatgaacgggcggctgattttgaaacccacgctgccagtggtcattcatatgcacatcacttgttgattgaacaaacgatgcattatgtgaaagaaggcggctatggctttttcctagtaccaaatgtgattttggaaacggatgaagctaagcaactgattaaatgggtgacaaaacatgtctatttgcaaggcttattgagtttaccagcaaacttgtttaagactaaggaaggtcaaaaagcaattttagtccttcaaaaacaaggtgccggggctaaacaagtggaccaaattttattaggtgaatttccaaattctaacgatcaaaaggcgtttgcaacgtatctacagaagatccggacttggcataaagataatttacaataatcgaatagaaaaggtgattagatgtcaaaagtattagcaattaacgctggtagttctacccttaaatggaagttatttatcatgcctgaagaacaagttgtcgcacaagggatggttgatcgtttaggattatccgattcagtctttaccgttaaatacggggatggtcaaaaattctcaatgacccaggatattaagacgcaagatgttgcggttgatttgttattgaagaagttaatcgaatttaaaatcatcaatgaatatagtgaaattagtgggattggtcatcgggtcgttgccggtggggaagactttaagtcatccgcattaattgatgaagcgtcattaaaacggattgaagaattgtcagaatacgcaccattacacaatcctgctgaagcaggtgttatccgtgctttccgcaagattttacatgatgtaccacaggttgctgtttttgatacatctttccatacaacgatgcctgaagaaaattatctttacagtttgccgttggaatattatcacaagtatggcgcacgaaaatacggtgcccacgggactagtcatcggtatgtttcccaccgtgctgctgaaatgttaggcaaaccattggaagaattaaagatgattaccatgcatcttggtagtggtgtttcagtgactgctattaaagacggtaaatcgttggatacatccatgggctttacaccacttgcaggggtgacaatgagtacgcgttcaggggacattgacgcatcactcgttgcatttttaatggaaaaattaaacattaaagatccagcagaaatgatcgatattttgaatactaaatcaggtatttatgggatttctggattatctcctgatatgcgcgatcttgaaaaaacgcgtgaagaacgtccagaatcacaattggcaattgatatcttcgtcaatcgtttaatcaagtatgttggttcatacgttgccattatgggtggtcttgatgtcctagtgattacagccggaatgggtgaaggtgacatcttaatgcgccaacgcatcgccgatcgcttgagtttctttggcgttaaagttgatccagaacgcaataacgtgatggctcaagaacgcgtcatcagcgctgacgattctcgcgttaaagtattattagtaccaactaatgaagaagtaatgattgccagagacgttgttgaaattggccacgtctaaggcatcagtgaaaatgaccagcgcatggctggtcattttttagtggagggaatgggaatatgacaggttttacattattttatggcttattggcaattgccttgctcattatctggctgattgttgaaacgaaaatggtttggcgcgcaaaacggaatcgactatggacgatttttttatgttgtgctggaatcctcttactaggtttaacgttagtgatgggcagaacgctcagcgatcaaatcacaggtatcggctctgttgtaattttaattgtgattgctttttggcctcgtggtttaaccaaaacaagtttgattgcaaacttaaatactattcatcaatttgcagcgatttctaagattgaattactaacacaaggtgacttagtcgaagcttgtttttatgtcggtgaaattcggattgccaagttgtgctttaaaacgacggtagaaaaattacaaacctttttaaaaggccggtttcctaagaaacgcttagtggtgaaatagggttaaagtctttcatattactggctgatatgctaaactagtatttgcatatcggggccgttacggattcgacatgtgtaggtgagcgtgagttgcacttcgtaggttacgtctacgttaacaacgttacagttaattataactgcaaacaataacaattcttacgctgtagctgcctaaacaccagcatagcatgatccgcctgacttcacccaagggttagatccgggtctcaaattaattgggttacgttaaacgctgccgtttgaggtgtttaaaagagatttgcaaactagctagttcatccgagcttctgtcggacggcgttttggactagcgaactcctaaatcgttcgactatgagtgtagagattgacgtggcaatgcgcatggacgcgggttcaacccccgccggctccattagataacaaggtgttaagcagaattaggcgcttaacaaaaggcgattaacactaccgtaacggtgttaatcgccttttttgtttgcaaaaaaataacagccacacgtgtgactgttacattaattgcttatgcccaacggtttgtttttgttggtaagagcattaggatatagaaccaaattgtcccgataagcggtatgaattcaatgagtacccaccagcctgagcggtctgtatcgtgaagtcggcgcattttaacggataaagttgcaatccaaacaatgaagacgacgatgttacgacccattgagatgcctaaatccccaatattatagatttctgaaattggatggccggttattgtttgaataataccgatgataataccacctagaatgtagttaatgatgattggccaccagaaatcaggtcggtttgaagtgcctgagaaatcaaaaatccgggaccaaaaactttgatatgatttaaccatgatgtaaaacccccttctccttatcagcttttcgcgtcgtcagttctggacgagatgagaagttatgataaatttaataacttcctaccaaagatattatgacatacttaaacgagttttttacagtttttagcttacatagagaatcaataatttatgcgccaacgcccattaatgaagcaagaatgaataataaccaaatgtgaattgggtagaacaagtagaagaaatacttcatgctacgtcctttttgtccgttgtacaagaggattgggataatcgcgaagatcatcatccattgcgtattgctagtgaagagtccagtgaaggcaaatccggagttgattccagcgtcaaggaatgcgaaaacaagaacggtaagacattgtaagagccggttgtttcggaaaagataaaaaaatactcctatgtagaggagaaggccattttccgcaagcataatggttggaataaccattgcgagattggcagcaaacatcattgtcttagggttagcaattagaccaagcgccaataatgataagaggataggagcaataattgccagtccaccaagcaaaatttgtttggaatggtgcgtgcggcgaccgacactaatttcttgaatcccatacattgctaaaacggcaatgtataaatcggtaaaaatattgtttgacagtgcgaggttaccgacttcgaagaagtgttggacaatggggcttcccaagttcataatccaaaaaccaacgagtaattggaacatgtaacgtttttgattccgcgtatgtatgaatccttcaactgccataaagaagaagatggtggcaactggtcgtccgaaccaatcaacccagccagggaccccagccccggcgaacatttggtgcacgtgatcaataaacatgaggataattccaattacgttgatgtcgaagttatttaaaacttgatatgatttagtctgcataatagcctccctaaaagttaagtaagtacattatcgtatgtttagcccatattattaagttttaaatggctagtgacaataatgttagatagcaaaaaccacgataaaaggaatttatcgtggttctgagcttatttagcaatttggcttgtgccatctgcgtaatttaatgtaacgccgtcttggacgttaaaaatgtaagtgttaaattgaatgctgttatccccgacggattggccttccatttgaacgccgcgggctagcagctcattatcgttaaaaataggtgtgacacggtaacgaacaaaacgattagggtgttttttgagataataagcaatatctgattcatgggccagcatttcgggtgcgtttagctggcgtgttcctgtcatcagattctttggattattattttcaccggttagttgatagccaattaaatgactccgattatacagccagtcagatttaatccgcttattatgccaaccggtcggattccaagtgagtccttcgcgcttggcagtaggcatcatcgattgatttaaaagaacatttgcagcaccaacgcgatttagtgcgtcgagattactaaaggtttgccaaccaccgtgatcggtagccaaatcagtagcactgaagcttggttggttattattgacgagtacctcgttttcaccacggtaggtgagggccgcgagctctgatgtgttatgacgctcaggactagtcgtttgcatttgttgctgatagttagtgagttttttgtttaactggttaattttacgttgaagcgcattaatttgacgttcggtttttttgttgtgcgcattaatgcgcttggtttcttgacgtaaggtggtagcgtgaacggtagttggttgttgcaaaagggttccgacaccagcaagtgaaattgttaccaccacgcgacttatcaaacgggttgctttcattggctaatcctcccatccgcaaagggtatagccctctgcttgtgcttgtgacaatggcatggttgtagtactgttggcacgacttaagccacgacaattgggatcaagatggtattttttaccagaattaggggcaattgtcaccatttgttcaacttgttgagcactagcagcttgttgtgcttgttggcttgcctgaattgcagcctgttgctgagcggcctcgctagcttgactagtagcggcgattgaggctgaagccgcacggactctttctgactcagacgctttttgctgctttttaacaagtcgtgattgactggcaacttgttttgtcagttggctagcctctgttttctttgtagctagttgtttttttaaagcgctcgagttagcacgggccgccttgttttcgcgtacatcaacttgatgttggctggtcttcttggaattcgcagcagccaccggcattaatgaaccgcctaagctgattaaggcgatgatgataatcagtacgcgacgccattttctgggtcgttgccggttaaagaatagtagtgaaatcagtgcgctccccaagaacgctaaaaataaataggacataataacctccaaagtaatgaataacagttcttaacgattgtatattgtacataatatgaaagcaattataaaaagcctaggcgtacctaggcttttagcggttaatctttggttgtgagtgaaacaattgcttttgtttgatagtatttttcaggattggtttcaaaagttaaccaatctgcatcagcgaatagaccagccaatgcaagaattgggcgttctttagcgagttgttgttcgctagaagttgcaatggcgtcttggtagctaccattgaagatttcatctagataaaaggcttgatcatcaccaacgtttaaataggtagtatcattcttccaagcatgtagcaaatccatttccgaaaaagtaacggtttcgttatttgaaaaagtcatgataaattgcatatgggtcaactccaatcaattaattaagcaacaatctatttggttgcctgcctaaattatagcatttagataataaaaggcgaaccttttgacagtcattgtggttaaaaagtagaatgaaggtgaacaaaatagaaaggaagtcattgatatggcaaacgaagaacgattagatagtttgaaaaatgtaattgaaggcacagttaagaaggttgtcagtgaagtgacacctaataaagataagaaagaaaaggcgcaaaaagctgacaaaaaataggacttagtaatgaagtaaaggtcaaaatcatccgtttggttttggcttttttattggaaagccgttaaatgcgttcgcttttacgaggcaggcttggtataatttaaaggatagtcagaggaagtaggtacaattaatggattacgcaggaatgttagaccggcaaaagcacattcgtaatttttcgatcatcgcgcatattgatcatggtaaatcaacattagctgatcggattctcgagatgacggatactattgccaagcgcgatatgcaagcgcaagtcttagatgacatggaattagaacgtgaacgtgggattaccatcaagttaaacgcggtggaattacactaccatgccaaagatggcgaaacttatattttccatttaatcgatacacctggacacgtcgatttttcatacgaagtgtcacgaagtttggcagcttgcgaaggcgccttattagtcgtcgatgcggcccaaggggttgaagcacaaacgttagccaacgtttatttagcggtcgacgatgatttagaaatcgtccctgtcattaataaaatcgatttaccatctgcacaaccagacgttgttaaagcagaaatcgaagagatgattggtttggatgcttcagaagccgtgcttgctagtgctaagagcgggattgggattgaagaaatcctagaaaaactggtaacggacgtgccagcaccaacgggtgatttaaaagcaccattgaaggcgctgatttttgattcgatctacgatagttatcggggtgttgtgttaaacgtgcgggtttttgatggcactgttaaagtcggcgataagattcgcttgatgaataacgggaaagaattcgaagtcactgaagtcggtgtgatgtcgcctaaagccgttaaacgcgacttcttaatggttggtgatgtgggttatattacggccagcatcaagaccattcaagatacgcgggttggggatacggtcacccttgctgacaatccggcagcagaagcccttgatggttatcggcatattcaaccaatggtttattctgggatgtatcccgtggataacgcgaagtttaacgacttgcgtgaagcccttgaaaaattacaattaaatgatgccgcgttggaattcgaacctgaatcgtcacaagcattgggctttgggttccgttgtggcttcttaggcctcttgcatatggatgtcgtacaagaacggcttgaacgggaatttaatcttgacctgatcatgaccgcaccatcagtggattatcatgtcgatttaaccgacggcacagaagaagtgattgataacccatcagaaatgccagaaacatcaaatatttcagaagttaaagaaccgtacgttaaagcatctatcatggtaccgaacgattatgtgggggctgtgatggaacttgcacaacgtaaacgcggcgaattcgtcacgatggattacttagatacctatcgggttaatgtcatctacaacatgccactgtctgaaatcattttcgatttcttcgatgacttgaagtccaataccaagggttatgcctcattcgattatgaagtgactggctatcgtgcgagtgatctggtgaagatggatattctattgaacggtgaatccgttgatgccttgagttttatcgtgcaccgtgactttgcctttgaacgaggcaaagcgattgttggtaagttgaaagaaaccattccacgtcaacaattcgaagtgccgattcaagcagctatcgggaataaagtgattgcccgttcaacagtcaaggcctaccggaaaaacgtgctcgccaagtgttatggtggggatattacccggaagcgtaagttgttagaaaaacaaaaagccggtaagaaacggatgaaatccgtgggttcggtggaagtcccacaagaggcgttcatgtccattcttaaaatgaatgatgaagataaagccggtaaataaggattcttaaaaatttaataatgataaaatagcagttttgccaacattttgccaacgttaattttcgttggttggcaaaaccgctattttttatgtgtttaaaactattcaagatagtgctcttgccaacattactcgttttgaatttgttcgatcagactaactgtatttttgcgcattttatgagtgacatgagaataagtatccattgttgtgctgattcgagaatgccctaaacgttcactaacgactttcattttttctccggcttctagcagcatagtagcgtgagtgtgacggagtgaatggaaattaaaattcatatgcaatttatcttgaactaggcgtgctttatatttaatcgtgttaggaagcacgggtgatccattttcttcggtgcaaacgaaattacttttatcgtaaagatgaccatacctcatttgattttccatttgagatttacgttttccttttaattcgtttactaaggttttaccgatatcgatggttcgataactagccttagtcttaggacttgctaactcataagtgcctttgccgtgctgtatcatgttgctatcaacggtaatagtattattgactaaatccactttgtcccatgttaaggcgcatatttcaccacgacgcataccggtattaaatgctattacaagtggcatgtgaaatgagtcggctactgggaagtaatccataagttctcgatattgatcaagtgtgataatttttagatcttgcttcgttttctttggttgtggttcatattttggcatatcaacatatagcatagggttttctttaatgatgcgataagggaagaccgctctgcgtaaggcctgttttgtgacggtgtaaataattgctactgtatgcggagcaagagggacgccttgcttagttgttgcattatccgcgatatcgtcaatgaattcttgcagcatttcaggtgacaaggttcttactctgtatttacctagtttagggatgatgtatttttttagaatatttctataatttttaacagtgttatatttcaggttacgttctacataattaactaaccaataattaaagtaatcagcaacgcttattttatccagtttaatttggacgttgccattctcatattcatcaatagcttttcgaagagcttttttagcttctttctcgctatatccgccgacacgttcaatgcgttttcgtttcccatcaacttgagcggcctcaaatgaatagtaccatttatcaccgcgttttctgacgttaccttcagccataattatctactcctatcatttttaattattgaaattgaatacaatgtatgcaaacatatgttcttttaatgcattaaataatagcctatctatattgttcgataggctattattcaaattccatttcaattactgattcttctaggtcgcctaagatattgttggcatccataaattttatccaactatcccgagggttatatttatcttctttaatagtagatttcaacttgttaaaaatactatcgataaattgatctagcatcttatctacagcacgctcaattttagcggcgttccaacgtttagccggttgccgtttttgattcttcatattctgataatctaaagccttgcttttaaaggtgataactgcagttgaattcttttctaggtattctagtaactctagtttattcataagtaaaacactcctcatttattctaagttttggatacgttgagcgattttcgcttcacaccatttcaaaaattggagttcattaatagttggtagattaaactcttgagcatattctatcttttttgtacttagttcttccgtaaaaggcttttcaataatgccaataacgattagctgagtagtagcagtaggttgggactgtgagaaagcgccacaagcagaagcgagagccattgcttgtttgcggttcatcgtttttaaccggccggtgaaagatacatgcattcttgttaaatcaatcataattaacaaactcctttcaaaatgttaaatggaccttgtaggactcgaacctacgaccggacggttatgagccgtctgctctgaccaactgagctaaaggtccaataaagtagcatgaaaataaatgctactttgatttttaaataaatagttagttattattctgctaattccttaatatattccgcttttttggagaaaagtaccggttttattccttcaaactcaaataaatttataactttttcatctactttagaatcatcatttatgaaagcatagaacgacgtttctggtataacttctttcgcttgtcgcatgtccattgcaattgatttagcgtagtattcattattggatgaattcataactctgattaaacgttctgggatatttttaaatccaggaatagaaaaatcaaaatgatgtaccatacctgtcgccccaataatgtttctgttggtaacggagcggatattattatcttcaagaaatccagctacttcacttaaaaatatagatgcaactcgcttattagataataaaaacatatcattaacgaagagtactgcttgaattaataaattctgattaactgcatagtctgcaatcgaagattcaatataaagttcattagtatttttgtctaaattaacggcaaatgattttagctgccgtagcatgatatttactttattttttgacttatttataaatataccatcagactccagatcatcgagtgtatagcctgcatcggttatctttatatggccattttttaattcctgtatataaattatgatcgtatcattatgcctattgtagaatggggtatctaatctaattactttttcgctaatgctagataaatttatgctttttttgttaaaatcatttatcgctttttcaatactttctaaagacaacatacggtatagcctcctttctcattaagagttacataattatagttctattgtaactaatgtgcacttgtattggtactctactagatagttttcgggcgggtcggcgtaactacaccatctttcaagttggtaaagccaccctactgcgggtgagtgatgtcatgaccttaaaaaaatcagatgtctataatccagacggttctgttaaacacacggcctttattcatgataaaaagactggtaaagcaaatacattatatttaaatttttaaattctattgtcccaatattgtcccagaagagtacagaaatactggtactacggtaaaatatagtcctaatataatcctgtactctccttactataatggaaaaagcaaaacagttattgttttgctttttttttggtattttttaacagtttccccttattataggataagttacttagttttatttgttgaaatatgatattattaaccttaaggggatgagttaatgacagataaacattattacggcaactacgaagtggttgaagaacgggaatcgcaaaaatatgttgcaacgattaaaatacataatatggttaaaaaagtcgtgatgcaagatgatgctctgcaaatgctcgcacaaaatgatgttttacccgaaacggtggttcataatattattaaagaaccaaatttgctgaaggaacaagtcatcatttctggtgctaatttggcccaatacttagattaaactcaaaaataagaggggctagaacaagtgaattgttctagcccctcttatcatatttttaggcttcactgatgtcagcaaaggtggcttcagtgacccgctgtaagtcttgcggattaatctgaattgagcggccaattttaccggatgagacatagatgaatggttccttttcagcctgttggtcaatgtaaatcggatagtgggattgttcccagattccaacgggcgtgttagcgccatgttcgtagccagtagtggccacgagctcccttaatgggaccatcgcaatttttttgttgccagaaatttggcttaattttttttcgtctaaatgacaatcaatcgggacgacaccgacgattgggccggtactcttaccagagagcaccaatgttttataaataagatgttcatcgatatcgagatgatcgaccttcatttgggcaacgttgtggacttcctctgttgggaattcaagttgggtgtaggccactttttgtttatctagaattttttcaactaatgttttggataatgcgttttgctttttcttctttcccataatagactcctttaatgaatagtgttagtttacggcaatttggtttaaaagtaaatttaagactgcaatgataacgtttcgttgtataataaaattacataaggagtgatgatatgttgtggtttaaaaaacaaacagaaaaggacttacagtcccacgattttacccagttggtgaagcatgcgcgtaacgatgaaatgcattaccaaaagattcaagcgacatttgctggcttgaaaaaggcatatcaccaaccaaaatcgaatcaattaccaaaaaaagactaagttcgcgttgttggtgacagtatggcatactatatgtaataaataacgggtgggtgacacgatgaaacgacaaacttggcatttcctcttttataaatcagccttcacaaaagaacagattgaccagttattggcttatttaaaacaacaacaaaattttggtgggtttccgattgttgaattaattggtgatggcgatagtagtgatattcggtttgtcacgatggtttttgatccgttggccccgattgaagcccatctacaatcagaaatggctaagtttatgttgatgcatgccattcgcccagatggcaacacgccagaagctgatatgcggctatatggtcgtgtgatggcagaatctgatgcagcactcggaattgagttccaacgttatgacgatcagagtatggacgttatttattggggtcagaaccaagcagcacattaagtagaattacgattgaaagtctgggacattttgttctgggcttttttgaatgattgctttagattcaagtcataatcaggtatgatgttaatacgttcaactttaaaattgacttaaataacgactaattaaaaggatatggtgaatacagtggctgaaatggatatgttagcatttttcgatgcagaattagatgatttacaatttagtggggatatgaatatcaactgggacaaacaagctcgggcgattgaattggaattcacattaaacgtgactaaggaacaagcaattgccgttgaagatcaaaatggtgaattgaacgaatcggatgaaatcagttatgaagatgcgattttattcttcgatgaaagtaagatggacggctttgaatatgcagacaattatttagcagtgattccatttgctggtcgcaaggggttaaacgcacaagtcggtcggggctttttcaactatttacaagacttattagatgaaggcgaagatcaattagccgcttttgtgaatgatgaatcagacgaagaaacctttatcttaaactgggatgacactgttttccaagcaactgtcgctcaagcagatgatcaattagcgaaaaaatactacgcttaccctaaatactaagcaacccgcattaagaaggagacatgctacatggaatggacaaaagtaacggtcgctactgttaatgaagcagtggaagcaatcgccaatattttaacggaaaatggtgcggaaggaatccaaatcgaagacgcagccgattatgaacatttaaaggcaaagccagatcaaattattgatctagacagtattccccaccttgaaacgggtgctgcagtgaatgcctttttcccagaaacagtttttgtgccggaaaaattaccgttgattgaacaacgcgttgcccaattgactgactttgggttagcgattggttctggtaaggtgacattggcacaagtcgccgatgatgattgggcgacagcttggaagaaatattatcaaccaacgcggctaactcgctttttaacggttgtgccaagttggaccgactatcaaccgactgatgaacgcgaagcactgattcggatggatccggggatggcttttggaacaggaacgcatccaacaacccatctatccgtacaaatgttagaaatggttttacgcggcggtgaatctttaattgacgtcgggactggttctggggttttgagtattgcggctgcgcatttaggggtcaatgatattcgcgcctatgatgtggatcaagttgcggttgatgccgctaaggaaaattttgccctcaacccagtgaccgctggcattgatgcccatcccaacgatttgttgaacgggattacaacgaaagcggatgtgattgtggccaatatcttagcagagattatcgtgcccttgattccccaagccaaggctttattgaatgacaatggacacctattactggccggcattattgcagataaagaagcacttgtccgtgaaacgttagcggtgaatgattttgttgttcaagaagcccttcatatgggtgactgggtggcattaattacacgccaaaagacggacgacgattaagaggagtatggcatgcaacgttattttattgatgaagcaattcaagtagaacaacaagtgaccttaacgggtgaaactgcacatcatatgctaaaagtgatgcggatgcagcctggtcatcgtgttgaattggtaacgccggatgaacaagcattcatcggtgaattaactgaactggatgcaactgacaaaacagtcaccgttacggtgcaatcgccaattacaaaatcagttgaattaccgattgagacgacgattgtatgcggcttgtcaaagggtgacaaaacagactggattgttcaaaaaggcacgcagttgggtgcacaccggtttattttctgtaatagccaattctcagtcgcacgctgggatgataaaaaacaagctaagaaagttgcgcggcttcaaaaaattgcgcaagaagcagccgaacaagctcaccggacgcatgtaccaactattgaatggcgcaacagtttaacggcggtcgcacaagaatcagcgacgattaaattagtggcttacgaagagtcagctaaagacggtgagcatgcccaattagttcagagcttacaaacagcccaacctggggatcgattactttgtgtttttggtccagaaggcggcgttgcgcccaaggaaattgagatgcttgcggcggctggctttaagatggctggtttaggaccacggattttacgggccgagaccgcgccgttatatctgttaagtgcgatttcgtatgtgacagaattggctactttatagtatgatagatgtaatctttttacagaggggcacaacatgactaaatttatgaataatcgttatttaaaaatggattgggtacgctatttattagtggccattctcttggcggtcgttttaccgctagtgtttggtgtcttgcacatcgataaaacgtggcggattggactgctattcatggctgtcaatggttgcgcagcctttatgattgggtatcgtgttcaaaagacccatgcagcttggtatcacattttgtacctgccgattttatttggattgatggtggttgtgcgctacgcagattataactattggttcgttcctatttattgtttattaagttacttaggaattaatactgcgtatgaacgccgttaagcaaactgactcgacagttaattagttgagtcagttttgttgtattcagtacatttttaatcgagtaagaggaattggagtgaggcaggatgccagaagaaaaagtaatttcacagcaggaagtgctacagttatgtcagaaatacatgaatactgagcatcttgcttttgtccaaaaagcgtatgattttgcagcttatgtgcataaagaacaagttcgccaatcaggtgaaccgtatattattcatccaattcaagttgcagggattcttgctgaattgaagatggatcccgccacggttgcttctggttacttacacgatgttgtcgaagatacgaatatcacgttaggtgatgttgaagagatgtttggcaaagatgtcgcggtaatcgttgatggtgtcacgaaattaggaaaaattaaatataaatcacaccaagaacaactggctgaaaatcaccggaagatgctattagcaatggctaaagacttgcgggtgattatggtcaaactcgccgatcgcttgcataatatgcggacgttgaaacatttgaaacccgaaaaacaacgccgaattgctaacgaaacattggaaatctatgcaccattggctgaccggttagggattagtaagattaagtgggaattggaagatatctcgctccgttatttgaacccacaacagtactatcggattgtgcacctgatgaattctaagcggacacaacgcgaatcttatattcaagaagcaattgaagacattaaagactcaattgctgatttagatatgaattacgacatttatggacgaccaaagcatctttactcgatttatcgcaagatgcgcgaccagcataaacaatttgaagaattgtatgatttactcgcaattcgggttgttgttgactcaatcaaggactgctatgctgttttaggagcaatccatactaagtggaaaccgatgcccggtcggtttaaagattacattgcgatgccaaaggccaacatgtatcaatcgatccatacaactgtgattggtcccaaaggcaaaccgcttgaagtgcaaattcggacgcaagaaatgcacgatgttgctgaatatggggtcgctgcacattgggcgtataaagaaggcgttaaggaacagattaagctggatgaatcagggcgtaaactcgatttattccgtgaaattcttgaaattcaagatgcttccgatgatgctgcagaatttatggaaagcgtcaaaggcgatatctttagcgatcgcgtttatgttttcacacccaaaggcgatgtttatgaactaccaaagggttcagtgccactggattttgcttatttagtgcatactgaagtcgggaaccacgctgttggggctaagattaatggcaaaattgtaccgttgaactatcaattacgtaatggtgatattgtcgagatgttgacgtcaacaagtgcgacaccaagtcgtgattggattaagctcgccttcaccgcgcgtgctcggaataaggttaagcgctactttaaaaaagaagatcgggatgaaaacgtcgaaaaaggacggacggctgttgaacatctgttggtagaagatggttatacaccaaaagaacacctcactaaagccgagatagctgtcatcttaccgcattttaattttaatgccgaagaagaactgtttgcagcaattgggttcggtgaaatctcaccacagtcagtcgtcaatcgcttaacgattaaagaacgacgggcaaaagaagaaagtgaacaaaaagcattagaagctgagattttatcagcgaaggattcacaacaaccagggcctaaagcaaacggtagtcatatcacaatcaaacatgaagacggcgttgttattgaaggtgtcgacaatgtcttagtgcgcttgagtaaatgctgtaatccagtccctggcgatgatatcgttggctatgtaacaaagggacgtggggtttctgttcatcggcgcgattgtccgaatatcgttgatcgggcagatatgaacagtcgattgactgaagtcagttgggaaaataccaacgctaagaatgatcaactctatgatgcgaatttggaaatctacggctataaccgtggtggactattgaacgatgtcttacagtctttaaatgcacatacgaaacagctaaataatgtgatggggcggattgatcacgataagatggcggatattcatgtgacagtcggcattcgcaatacagatcatttagaaacgattatggaagccgtgaagaacatcccagatgtttacgaagttaaacgggttcaaggataggagcgacttaatatgcgagtagtattacaacgagtgagccaagcaagtgtcacgattgatcagacgattgttggcaagattaaccaaggctttttgttattggtcggtatttgtgatgatgatactgaagctgatttagattacttggttaagaaaattagtcaattgcgcgtttttgaagacccagatggcaagatgaatttggcgttggcccaagttgacggtgccattttatcggtgtcacaattcaccctttttgctagcactaagaagggcaatcgcccaagctttactgcggctgggaaaccggactatgctaaacgcttatacgaacagtttaatcaaaaattagcagcgactgggattcccgtcgcaactggagaatttggagccgatatgcaggtggctttggtcaatgacggtccagtcactatcctatttgatacaaaggagaatggataattaatgagttatcaaaatgcgatttgggatttcgatggtacattgtatgatacttatcctgttatgatgacggcgctcagtcaggtttaccgtgatcatcaagtcgcagtcgatcaatcgcgcttataccaagcgattaagcagacttcaattaaacgggaactgcagatgcttgctcagcaaactaatgtttcatttgaacaattggatcgagaatatcatgaattagaacaccaattacaacagacgccgcaaccttatccgggggcagcggcgattctgaaacagattagtgcacatggtcagaatttcttattgacccatcgtgatgatgctgcagaaaaatttttggcagcgcatggactagcggattattttactgaaattgttacgagtcagagcggatttgccaggaaaccggcgccagatagtttgaacgatttatgtgatcgttatcagctggataaaactaaaaccgtgatgattggtgatcgcgcattagatattgaagcagggattaacgcccacgtggcgacggcctatttcgatgttgatcgattaccaatcacggtgcaaccgacaatcacaattacgcaattaagtgcgttagggaaatattttttaaactaaaaaaagcggtgtcgacaaattgaaagtgtcgacaccgtttttttggtttaaaggagtgtgatgattagaaaggataggtaccatgctgtggccatcacgaggacaaagcgccaccaactccgtagaaacttacgtaggtacagcgcacggtcgtagtaaaagcgcgttaagctccagatgattccccacagacagattgctaagcaaaagaaccagccagctttactgaaaattggcatactcagaaagatagcacttactagcaatggaattggtagccaattaatataatgaaaacgatgtttaaatagacgctgagtcaaccggtcgatacagtagccgagtgcgacacagacgggcggtaagcctgcaaagaaaagtgttgtgctaaatggcatttaaatcacctcgaaagttaatagtcccattgtaccgtcttttggaaaagataaaaaggactgagttgcactttcaagtgattcggtgtaaactgctgataagaaaaaagtctaggtggtggaataattgaagaaacaaacaagcacgtttagtcgcattactaaaattttcgtttgggtaatgttaatcgccacagtgggctcagtcatttttggttcactcgctgcaactggcattttaaacttctaaaaattagattagagtgagcaattttttgcggcgttgcttagacgtggtgcgacagcccaaaataagcttacttaaattaacaagtgaaacggccatttcggttaacgaaatggctgttttttttggtcaaaaaggctagtgatataaatatcgtgcacaattggttccaaaatgataagattttggttttttttggcaaaatgtggtagaaagtgggggattgtggtagactaaaatcagttaaggtgggtaaaggggtgaatggttatgttcatgggcgaatttcatcacacgattgatacgaaaggtcggttaatcatgccggctaaatttcgtgaatcattaggtgcggaatttgtactcacccgtggcatggacaattgtatttttggttacccccttagtgaatgggaacagttggaagagaagttaaaaaaactgcccctcgctaaaaaagatgcccgcgcgttcgtccgctttttctactcagcggcggtcgaatgttcccctgataagcaaggtcgggtgaatatcccagacacacttgctaaacatgctggtcttgaaaaagaatgtgtgttaatcggggtctcaaaccgcattgaaatttggagccaggaaaaatgggcgagctttagcgaagaagctgaagagaattttgatgatattgcagaaaatatgttagattttgatttttagaaggatggtaaatagatgacagaaacatttaaacatcaaagtgttttattgaaagaaacggttgatgccttgaatgtgcaacccgatggcgtttatgtagacgcaacattagggggcggcggccatagtgaatatttgttatctcagctgacgaccggtcatctttattcgtttgaccaagacgatcatgccttagcaagtagtaaacaacgattagccaaatatgctgaagcgggccaagtgacttttattaagagtaacttccgctatttaaaagcagcgttagcagaacacggtgtgactaagattgatggtattttatacgatttaggcgtatcatcaccacaatttgatgatgcccaacgcgggtttagttataagaaagaagccccacttgatatgcgaatggaccaaggggcggaactcagtgcctacaatgtcgttaatgagtggacctatcaacaactaattaagatctttttccgctacggcgaagaaaagttctcaaaacaagttgcacggaagattgaacaacaaagagcagttgcaccgattgaaacgacaatcgaattagctgatttgattaaagaagcaattcctgcaccagcaagacgaaagggtggacatccagcgaagcggattttccaagcgattcggattgcggtcaatgatgaattaggggcaattgaagattcactcgaacaagctattccattggtcaatgtcggcgggcggatcagtgtcattacgttccaatcgttagaagatcgtttggtgaagacgatgtttaaggaacaagcaacgctcccagatttaccgaaagggttaccaattttaccagaagaacaaaaaacggttctaaaattagtgaaccgcaagccgattctaccaacagatgatgaattagaagaaaaccatcgtgcacatagcgctaagctacgtgtcgcagaaaaacaaaaagaaattgactagaaggattgatgatgatggcaactaacacggcacgccaattagaaacgccagtagcaccgctaaaaacgcagcctactgtacataaacaagcagttgcaagccagtctaaaaaagtggctttttcagctgttgaaaaattagcgacgtcagttattggaattatctttttcgcgatgttggttagtttgttaaccaccaaaattgcagttgttaatgcacaacgaggattagaaagtacgactcaaaagatggcccaagtcagcgctaacaataatgatttaaaacaggagatcggtgaattaacaagctctgaccgtctgaatgcttttgcccagaaacatgatcttaaactaaatgaaaataatattcggaacgtgtctaaatgaaatcagttaagacacgtaagagtccacggcggaatcgacgcgtttttggcaggcttttattgctaattatcgcggcgatttttctagttttcgccggtcgttttgcttacattgctgctactgggcatattgcaggggtggatttaacgaaacgatcacagaaaaaatacaaagctgattccgtgattcgcgcacaacgcggtacaatttatgattctttagggaacgttttggcacaagacattaacgcctattcagtgtatgcggtattaagtcacgattacgttggccctaataagaagccgttatatgtaactgataagaaaaaaacagcgaaagttttgagtcgctatctaccattgagtgaagaaaaaatctataaacagttaacgccagctaaccgttcagtttatcaagttgaattcggaagtgccggccaaaacctttcactgagcatcaaacggaagattgaaaaagaacatttaaccggtatttacttcaatgagtcccctacgcggctgtaccctaatggaacattcgcatctcacgtcattggtatcgctcaatcaccaaaggacgaagacggcgctgatcaaagcctcgttggtgtaatggggattgaaaaatacttcaacaaacaattagcaggccaagatggttacaagaattttgcccgtgattcctatggatacacgatcaatcaaaagaaaaacaaagtaaaagccgctaaaaacggccaagatatttacttgaccttagattctcggttacaatcatacatggaaactttattaacgagcgtcaataaaaaatataagcctaagagtatgaatgccgtcttgatgaatgctaaaacgggtgaaattttggcggcttcacaacgaccaacctttaatgccagcactaaaaagggaattggcaagatttggcgagatacattagttgaagatggctatgaaccaggctctgttttgaaaattgcaaccttggcagctgccatcgactctggtaattacaatcctaatcagtattatcaatcgggttcaattgaagtcggtgacaagaagattagtgattggcaaacgagtggctgggggatgattccgctgagtcaagcctttgcacgatcaagtaacgttgggatggtcaagcttgaacaagccatgggtcctaaggtttggaaagactacattcagaagtttggctttttaaaaccaactggtattcaattacccggcgaaacagaggggacattgcaatatgttcggccactagatcaggccacaacttcatttggtcaagggattaacgttaatgtaatgcagatgcttcagatgacaagtgcgattgcgaacgatggcacaatgattaaaccgcagattttatctgggattaatcaggatcatcaagtaaaaccaatcaaagctggtaaaccaattaaggctagcacggccaaatctgtcttacaaaatatggaagatgttgtttatcaagattatgggacgggtcaggtttaccaaattccagattataaagtagccgttaaaaccgggaccgcacaaattactggtccagacggtggctatttaaccggcgcaagcaattatatcttctctgtatcagggattgcaccagctgatgatcctaagtatattttatatgtcacaatgaaacagccgcagaatatgacagatagtgctgaaagtattttggcacaggtcttcaatccaatgatgaaacgggcactggagtataccaaaaaggctgaaaaagacacacaacaacaagtaacagttccatctgtgattggtcaatcaacggatgaagcacaaaagaaattaacggatttaggcctacaaaccgcttctgtcggtagtgggaacttagtcgtccagcaattaccaaaggccaatagtgtgattttacctaaacagcgagtcattttaatgaccaatggagcaatgacgatgccatatgtcacgggttggtcgaaaaatgacatcttgaagctcgcacaattaacaggtgttgagattgacatcaaaggtagcggatatgcttatcatcaaagcctagcggtcaatgggttgctagatggggttaaaaaaataaaagtacaattaaaataagatagttggattaaaggagtttatgaaatggcagcaggacaatttttagtgcccttaatgagtgggtttgtaattacggtgatttttatgccgctttttatcgggtatttacgctttaaaaaagaggggcagacaatccgtgaagaaggccccaaatggcacgctaagaaaaatgggacaccaacaatgggcgggctcttattcattattgccgctgttgtttcaagtatctgggtagggttattcttaaaacagttaacgaatagtctattaattgccatgtttattctggtgttatacggtattctcggtttttcagatgattttattaaagttttccgtaaacagaacttaggcttacgcgcttggcaaaaattgttagggcaaattattggtgggcttgtcttcatcgctgtttatttccatgaaggcttcagtattgcacttgaaatcccagtaattggcactatttcaagtaactggttcttttgtgtattcgtcttagtgtggttagtcggtttctcaaacgcggtgaacttaacagatggcattgatgggttagttgctggtttggcaaccatctcatttgcaacttatacaattatcgcctttcgtcaaaaccaaattgatgtcgccattttcggcctcagcattattggcggattacttggctttttaatctacaataaaaaaccagcgcaaattttcatgggtgatgttggttcattagcgcttggtggggcattagcggctatgtcgattctattacatcgtgagttctcactgctattggtcgggttagtatacgtcattgaaaccgcaagtgtgatgttacaagtcggttcatttaagttattccataagcggatttttaaaatgagtcccattcatcatcactttgaaatgtcagggtggagtgaatggcggattgatatcagcttttggttatttagtatcatctgttcagcaatttatctgttaattttttagaagagggcgaatttaatgaaggccagcacgacgtatcaagatcaggctgttttagttttaggattagggaagagcggctttaatgctgctaaattgttattaaaattaggggcgattgtgaccgtcaatgacggaaaggaacaagaagacaatcctcaagttgcacaattgcgtgaattaggggcaaccgtcattactggatcgcatccattggcgttatttgagcgcaactttgcatacctcttcaaaaatccgggcattcgttacgataacccaatggtggcagaagcgatggcgcgcaagattccagttttaacggaaccagaacttgcgtacgaagtgtctgaagcccaatgggtcagtgtgactggttcaaacgggaagacgactaccacaacgttaattacgttgatgttagatgaaaatcgcacccaggggcacgcatatgctgcgggcaatatcggcattccactaagtgcggtcgcccaaaaagtgacggctgccgatgtgatggtcacagaattatcaagtttccaactactcggtaccacaaccgttaaacctaagattgcagttttaacgaatatttatgaagcacatttggactatcatggctcgcgtgcgaattacgtggctgcgaaaatgcgacttgttcaaaatcaaacggctgccgacttttttgttgtcaactgggacttacctgaactacgtgaattgagtcaccaaactaaggcgcaagttgtgccattttcacggctaggcaactctgaagctggcgcctatgtcaaagatggccaactctgctttaagggtgaagtgataatgccagtgactgatattaacgtccctggtgaccacaatattgaaaatgctttggccgcaattgcggcggctaagctgatgggccaatcaaacgatgcgatcattgatgttttaacgacctttaccggcgttaaacatcggatgcagtttgtgacgagctatgaaggtcgccgcttctataacgactctaaagcaaccaatatggaagctaccgaagtcgcgttgaagagttttaaacaaccaattgttttattagcgggtggtcttgaccgaggctttactttcgaaccattattaccactactaaaagaacacgtaaaagcaatcatcttatatggtgaaaccaaacaattgttggcacagacagcacgtgaagcaggtattcccgtcatcaaaatagttgataatttaacaaaagcagtgcctgaagcttatgctgctagtgaagccggcgatgtggttttattgtcgcctgcatgtgcgagctgggatcagttcaagacgtttgaagaacgtggggacgtctttattaaggcagtcgaacaaattacagattaaattggagattctaaaatgagagtaatgatatctggtggcggaactggtggccacatctatccagcattagccctaattgaaagaatgcaacaacgcgacttgttggatgccgttttatatgttgggactaaacgcggtttggaaagcaaaatcgtgccagatcaaggcatcgattttaagacgttagaaatccaaggatttaaacgttcgatgaatatgaagggcattaaaacaaatattaaaacaattcaacttttcttgcgcagcgttaaagaggcaaaagaaatgattaaaacattcaaacctgatattgtgattggaacgggtggctatgtttctggggcattgctgtatgcagcaagtcgcttaaaagtgccaacgttgattcatgaacaaaactcagcagccggcgttaccaaccgctttttggcgcgctttgtcgataaagttgccatttcgtttgaatcagtcagtgaccaattcccaatgcacaaaattgtattaacaggcaatccgcgggcccaacaagttgctggaatgttaccaaacgaacgtttaagtgaattcgggcttaagactgacagtccgacagtgcttgtgtttggtgggagccgtggtgcaccaagtattaaccaagcttttatcgatgcagtaccagcacttaatacaaaagagtatcaggtgctatttgtttctggacgtgttcattttgatgacgttcaagcgcaattaaagacgatgacgctcaatgataatttggctgttgtaccatatatcaacgacatgcccgaaattttaccagatttaaaggccattgttggtcgtgctggtgcgacgagtttggcggaaatcacagcacttgggattccgtcaattttgattccaagcccctatgtaacaaatgatcatcaaacaaagaatgccgagagtttggttaaagaagacgcagcgattttaattccagaagcacaattaacgggtgacaaattagtccaatcattagatacgctttttgcaacccctgatagtcaacaagccatggctaaagcagctaagaaaatggggattccagacgcttctgatcgcattattgaagtgattaatactatcatctaagttaagaagggggcggatgacttgaagaaaaaaacaactaaaaatgggtcgctcgatccgctccaattactaaacgtttggcgcgcttatcaactaaagcgttggaagaaacaacgtcggcaacggctaacgcctgggcgaccaacgattagtggtcaactaccacatttaaaagcgcaacgaacggcaaagacaaagtggcggttgacagcgttattgagcaccttcacattgggcgcttgtgtggcaatctattttatgttgccgattagcgacgttcaacaaatgacggtcaacaggactaaatcagtgcctgatcagcaggtgattaatgcgagtggcgtacggattggcgataacgtcctgacacaaatctggcaggaaaaagcgattgagaagcggattcaccagaaactacctaaggtgaaaagcgtaaatgtcaaagttgatcagtttaatcaactgacattggcgattacggaatatcctacggtgggctatctagtgcggcataaacaatattatccaatcttagaaaatggcacgattttaaagacgaaaatgacgcagtctctgggtaatagccctgtctatagtcaatttaaaaatgacgccttcttaaagcaagggttaaaactatatcaagcctttccaaacagcattcaaagtgctgtgtcggaaattcgtttaacagctaagaacaataatccttaccaagttcacttatatatgaatgatggtaatgaggttgttggggatttgcggacacttgccaagaaaattaaatattatcccacactggcgaaacaaatggacggtaagggacgaattgacttagaagttggcgcttacgccaaattatttgataattctgaggccgattcaacaaaaaattagttaacacggtttaaaaagattggattggctttctaaatctagtcgaaatgtggtactatttagcataggaatcattttattctaattgaatgcaaggaggttccacacacttaatggagaattcaaaaatatatgtcggtcttgatgtcggaactacttcaattaaggtaattgttgcagaatcaattaataaacaacttaacgtgattggcgtcggatcagctagatcaaacggattaagtcgcgggacgattgtggacattgatcaagcggttaccgctatccaacaagccgtacaacaagcagaacaaaaagcaaatattgaaattaatcgggttgttgctggaattccagccaaccaactacaaatcgaagaatgccaagggatgattgcggtctctgatcaatctaaggaaattactggtcaagatgtgcaagacgttgctagtgccgcattggttcgaaatttaccacctgaacgtgaaatcctcaatatcttaccgcaatcgtttacggttgatggatttgatgggattaaagatccacgcggaatgatgggggttcggcttgagatgaacggaattttgttcaccgcacccaagacaatgattcataatttaaagaaatgtattgaaaaagcgggtttaacactatcacaactcgtagtgaacccattagcacttggtaagctagccttatcagacggggaacaagattttggggcaatcgttgtcgaccttggcggtggtcaaagtacagctgctgtgattcatgatcatcaattaaaatttacggcgattgatcaagaaggtggcgaccatatgaccaaggatatttccgtggtcttgaacacgtcaattgaaaatgctgaaaaagctaaacgagattatggcaatgctgattcattggctgcttcagaagaagaacaaattccaattgaagttgttggtcaagctttaccagtgcaagtgacagagaaaaaattagctgagattattgaagcacggacgatgcagatttttgatcgtttgaaagctgaattggataaagtacacgcttttgatatgcctggtggggtgattatgaccggtggcgtgacagctttacctgggattgtcgacttggctaaggaaatctttaattgcccagtgaagttatacattccagatcaaatgggcttgcggcacccatcatttgcccaagggttgagtttaattaactacatagctaacttgtcggaagttgattggttggtccaaggcgcacttggaaatgtagcacagactgaattagaccaaacagtgacgaaatcaacaatgaaatctcaagcaacaaccaaagaagtaccaagtaagaaaaccaaacctaaaaatcaatcaaaaaatgcattcgaaggcctgaaaaatttctttagtaacttttttgaataagggctagtcgtaacaggaggaaaaacagatggaatattcattagatgcagcacaagaaaatagcggcgcaatcatcaaagtaatcggcgtcggtggtgctggtggtaacgctgtcaacagaatgatcaacgaaggcgttaaaggcgttcattttattgcggctaacactgacgttcaagcacttgaagattcaaaagctgaaacaaagatccaattaggacctaagttgactcgcggcctcggtgccggcgcaactgctgaaatcggccaaaaagctgctgaagagagtgaagaagtcctcaacgaagccttaaaaggcgctgacatgatctttgtcacagccggcatgggtggcggtaccggaactggcgctgcccctgttgttgccaaaattgctaaagatcttggcgcactaacggtgggggttgttactcgtccatttacatttgaaggccctaaacgtggtaaaaacgccgcttcagggattgctgaattaaagcaacatgttgatacaatggtcatcattgctaataaccggttactcgaaattgttgacaagaagacaccaatgatggaagccttcaaagaagccgataatgttttacgtcaaggggttcaagggatttctgacttaattacatcaccagggtttgtcaacttggattttgctgatgttaaaacagttatggctaaccaaggctctgccttgatggggattggttcagcaacgggtgaaaaccggacagctgaagcaacgaagaaggctatttcatcaccattattggaagtttcaatcgatggtgcagaacaagtcctcttaaacatcacgggtggaccagacttgtcattgtttgaagcgcaagatgctgctggtatcgtgcaacaagctgcaactaacgatgttaacttgattttcgggacttcaatcaacgaaaatcttggtgatgaagttgttgtaacggttattgcaactgggattgatgaagataacaacaaacgtcgtccagcaacaaacaattcagcaccaaagacaacagcgccttcaacaccatcagaacaaaataatgatccatttgtagattgggatatgcgtcgcgaaccaagtgcccgcgagcaagcgcaagcaactgaaaaatttgatgaaattgaaaagaaagatttcgatatcttcaaacggacagcccaagcggatgataataagcaagataaccaaaatggggacgatgtgccgccatttttcaagcgccgtcgcaataactaaggaggatgactcatggctggtaagtttagtcttagcaattttttcggcatgtcagatgaagatgaatatgctaatacgcaagaaactgcggctgtcactaatgaaggtgaaccaagtgttcgcccgaataacgtcgtctcgatgcaagctgcgggagctactaaaatgaataaaattgtcttatgtgaaccacggatttattccgacgcaaaaaaagtcggcaaaagtttacttgaaaataaagcagtgattgttaacttcacacgaattgaagcgacacaagccactcgaattgttgatttcctaacaggggcagtttttgccatcaacggtgaaattcaacgggttggtgatcagattttcttatgtacgccaccgaactatgaaatcgatggtaatctttcagatattgtcgatcaaaatgattttgatattgaggtgaactaggtgcaactatttttattttatgtgctcttgatgctcatgtatgtggtacggatttatagtggcattgtcgtaatctattgtttattaacgtggattccagaggcgatgggcagtaaattaggacgctttgttgctaagttagttgaacctttcttagaaatctttgaccgcttcattcctgcaatcggtggtattgggatttcagccattgctgcgtttttcgttttatatttagtagaacgtgggatcggcttactcgcacaattattagtggggatgtaatcaatggtcaatcaagcagatgtctatcaacattttagaaaaagcgaggcgccatttgttgcgcaggttttggattggattgagcaagcacaagttgaatatcgaccaatcttaacggcgtttttagatccgcgtcaagcgtttattttacaaaccttggtcggtgaaaaaggggacgtccgttatcactttaatggcggatataacgctgctgaacggaaacgggcaatgattgctccagattactttgaaccaacggatgcggattttgagattcaattatttgagattcggtacccgattaaatttgcaaacctatcacatgggaaggtgcttggcacgcttgtgaatgctggcattgaccgtgatgtttttggggatattatgaccgatgaagaacgctggcaattctttgtgacgaagaagatggcaggctatgtcgaagagcaaatcactaagattggtcgcgtatcagttcatttgcaagaacaagactatacacagttgttgacgcctaaggacgcttggcaattcgaacaaacgactgtcagctcgtttcgcttggatacgatcatttcaactgtttacaatctgtcgcgacaacgcgctaaagaattaattcaagccaacaaagttaaactgaattggcaagcatttgataaaccagattttgaattagcactattagatatcgtctctgttcgtggttttggccggattcaactccaatcgattgatggtcagactcgtaaagaaaaatatcgagtgacactggggattttaagaaaataattgctgaaaaagatggaggaatttcaaaatggttttaacacctttagatattcataacaaagaatttaacacaaaaatgcggggttacaatccggatcaagtcaatgatttcttagatcaagtgattaaagactatgaatcagttttaacagaaaatgaaagtttaaaagcggaattaaaatcaagcgatgaaaaagtaacgtattttaatgaattgaaagatgcgttgaaccaatcaatcattgttgcacaagaagcggctgaccgtgttaaagataacgctaaaaaagaagctgaaatgattcaaactgaatcagaaaagaatgcaaaatcaatgttggatgatgcaactgaaaaatcaaaccacatcattgacgatgcaactgaacgtgcaaaacaaattgcaatcgaaaccgatgacttgaagaaacaaacacggattttccgtcaaagattacaagttatgcttgaatcacaattagaagtggttaagagtcctgaatggacagatttattagctaaagatgatttagcggaccatcaagctctttcagctgaaattgatatgacagaccttgacaaccatgggtcaaatcaagtaaactcggatgcagaagttaaaccttggggtcaaattgctgaagatgatgtgacaacaacgcaaaccattattttccctggtgaagaaacaccagtcgaagaagatgacaatgatgaagtgctctccgatgtagtcgaagacaccgattcagatgaagtggttgaagctgttacggattcttacaacccaattgaaaaccaagcaacagatttaaataaggactagcaagcaaaacatcatttaagcgagccaacgacggtggaaggttggtaatgctctgtttagcggtgtatcaccttatttcattccagatgaattgagtaatttgggacgcttaatgcgcgttattgcatgttgaggaaggtcattgaccttcaaatttaggtggtaccacgaagatttcgtcctattcagggcgggatctttttttgtttttaaaaataaaggagtgatttgatgcgtatcaaagaaacattaaacctgggcaagacagctttcccaatgcgagcaggtttaccgaatcgtgaaatcgattggcaaaaaggttgggccgataacaacctctatcaacaacggcaaaaattaaatgaaggtaaaccttcattcgttcttcatgatggcccgccatttgcgaacggcaacatccacatgggtcacgccttaaataaaacaagtaaagatattatcgttcgttacaaatcaatgaacgggttccgcgcaccttttgttcctggatgggatacacatggtttgccaatcgaacaagccttggctaaaaaaggtatcaagcggaaagaaatgagcctcgttgattatcgtaaactttgttacgactatgccatggaacaagtcaacaagcaacgcgaagatttcaagcgtcttgggatttctgctgattgggataacccatacatcactttaacagctgattttgaagctgaagaaattcgggtcttcggtgaaatggctaaaaaaggttatatctacaaaggtaagaagcccgtttactggtcaccttcatcagaatcaactttagcggaagctgaaattgaatacaaagacatcaaatcaccatcaatgtacgtggcgtttaacgtggtggatgggaaagacttattagatgcggatacaaaattcatcatctggacaacaaccccatggacaattcctgctaacttagggattgcggttaacccagctttcgattacgttcaagtgttagctgacggccaaaaatacgttgtggcagcagaacgtttgaacaagatgactgatcttcttggttgggaatcagttgaaattttgaagactttcaagggtgctgacatggaattaatgacagcccgccacccattatatgaccgtgaatcattggtaatcttaggcaaccacgtgacattagaaactgggactggtttagtgcatacggcaccaggtcacggtgaggatgattataacgctggcactaaatataagttaccagtcctttcagttgttgacagtaaaggaattatgactgaagatgcccctggttttgaaggcgtttattacgataaagccaacccaatggtgacagaagcgcttgaaaagaacggttcattattgaaactcgacttcttcacgcatagttacccacatgactggcggacaaagaaacccgttatcttccgggcaacagcccaatggtttgcttcaatcgatgcgttccgcgatcaaatcttagcacaaatcgaaaaagttgaattcatgccagaatggggtaaaacccgtctttacaacatgattcgtgatcgtggcgattgggttatctctcgtcaacgggcatggggtgtgccattaccaatcttctatgctgaagacggcacggaaatcatcacgccagaaacaatcgaacgtgtggcgcaactctttgcagagcacggttcaaacgtttggtttgaatgggatgctaaagacttattaccagcaggctttacacatcctgggagtccaaatggtgaatttacaaaagaaaaagatattatggatgtctggtttgattcaggttcatcacatcaagctgtgttagcggctcgcgatgacttaacttatccagcagacttaatcttagaaggctcagatcaatatcgtggctggtttaactcaagtttaattaccagtgttgcagttggcgaagtcagcccttataaagcagttatttcacaaggctttgtcttagatggtaacggtcgtaagatgagtaaatcacttgggaacacaatcttgcccgaaaagatcatcaaacaaatgggggcggatattgtgcgcctctgggtcgcttcagttgatgctagctcagacgtgaaagtcacaatggaaaacttccaacaagtcagtgaagcttaccggaagatccggaacacaatgcggttcatgattgcgaacacaactgatttcgatcctgctaaagatacagttgattacgcagaattaggctcagttgacaagttcatgttgatgcgcttaaacgcaatcattgccagctgtaaagcggcgtatgatgcttacgactttgccacagtttataagacaattaacatgttcttgacgaacgaattatcagccttctacttagacttcgccaaagacgttgtttatatcgatggtcaaaatgatgcgcctcgtcgtaacatgcaaactgttttctatgcagtagcaatagccttgacgaagttattgacaccaatcttgccacacacagctgaagaaatctggagctacttacacgaaccagaagaattcgttcaattagctgaaatgccagaagttgaacattttgccggtgaagaagacttagttgaaacttggaacgccttcatggggattcgcgacgatgtcttaaaagctcttgaaacagctcggatggacaaggtcatcggtaagtcattagaagcggccgtaatactttatcccaacgaagccaatgctgctttattagcttcattggatgctgatgttaaacaattattgattgtctcacaattaacaattgcggatcaatcagccgatgttccaacagaagcgacacaatttgatggcattgcggtcagagttgcgcatgctgagggggacgtctgtgatcgttgtcggatgattaagactgatatcggttcagatgataagttcccaatgctttgtgcgcgttgtgctgcaattgtcacagccaactacccagaagcagttgcggaaggtttagaaaaataataatcactaaaagcggtgcgaacttttacgttcgcaccgctttttttgtgcagtcaagagtaaatagataacgttttcatgataaaagattaatctttgctaataatttcactattaatgattatttgttgttagaatgaaaatagtaatcggaacgggtgggtaaatgacacgacgacaagcgactaagcgctatatggcaatgattttaatcgaattattaatggatcaaaaagcgacgaaattgacggtcgcgacttttttgaagacggctaatttatcacgaacgaccttttataatcattttccaacgggcatgtgcggcttatttcggtggacacttgaacaacagattattcaaaaagttgatgagagtatagtgagtggcgattgggaatccggctgtcatgaagtcgttcaatttattacacggtatcgcatgttttgcttgaacttatattatttagcggattatccagaacgccgccgtttttttgaacaggttatgaaacagattattcataaggcattacgccattacaaaacacaatacacgccacaacagttaaatcacttggaagacttttacggcggtgcaatcattcgccaattagattgttggtttgaaaataatttgcagaccgagccagaagtgattgatgagcggttatgtttcaatttgaagcagcttgagaaaatcgttaaaagtgactaaacaatttagtgatattgttcactttccgaacaattcgctgaacttgtaactggaatgctgcccaggttttgctacactaaggatgtaccaaaaaataatattaatagcaaccccacacaacaaaaagccctaccggaatacgccggtgggcttttttctatgctttaatttcgctgacttgtaaagaagcattcaataactgttcagcaacgagcgccaattgctgggcgtcaaacgctggtttaaacaatgcagtgtgcaaaacaccgattagaccccaacaacaataattcaaaatataatcagcgttttccggctgctgaaatggaatcacccgcttgccgtgagtcacggtcaacgcaactaatttattcattaactgtgaatcgggattgcgacacaatacccgtaacatagactcgttgtcttgcacatatgacaagacccatctaaagaaagtttggccaacaatctgtagttcagaaggcaactcaaaacgttctagcaactggctgaactcatttaaggtaaaatcttctgtctggcttaaaagatcgtagatatccgtataatgcaaataaaacgtccgccgattaatatcagcccggtcggcaatcatctgaattgtaatctcattaattgggtgttttagcaggagctcaataaaacttgtgcgaattaacttatgtgtccgtttaacccgtctgtcttgcagattaaccatctttcagcctccatttacatcacaattgactaacttgtgtgcattataacacagaaacacttagattgattattgttgaatcaactaaccatcgttatagtagccttaataacaagtcagcggaggtcggcatatgtttctaacaatccaagaattacgccataataagttaaaatttggcgcactgagttttatcatctttttaatcgttttcctagtactcttcatcaccggactagctgccggtttagcaaacgatagtggcgcggctattaaaaatacgccggcgacgcattttgttttacaagccggttcggaaagtcggttgagtcgctcggcactcacccaatctgattggcaagctctcaaacaccaatcactgacacccatcaacgtcacccaagccaccatcgagcggcctaaaaaacaaacaaaaactgacattgcctacattgcagttgacgctacgagcttcatgacacccaaagtcacccaaggtcaaaagctgtccaaccaagccacccaaaaagtggtggtcagcagcaagttacaagccaatggttaccaattaggcgacacctttaaagacagtaccactggtcagcaatttaaaatcggcggctttagcaagcagatggcttatgcccatacgcctgttatttatttaaaccaccaccagtggcaaaccatttttccaacgcaaaagacgacctataacgcgtttgctagcaaacggcccttgtcggttaacaagcactaccaagtgatcagcaaacaaaccttgattgataacatccctggctactctgcagaacaaagttcattgtacttaatgatcggctttttatacgtcatctcactgtttgtcctcgcaattttcttttatatcattaccctacagaaattacgggactttggaaccttaaaagcactgggcacaaccacacgctatctcagccagcacatcatctctgagattggcttgttaacggcagtggcgattcttttggctggcggtatcattagtgtcatcgcccagtcaatgcctgccagcatgccgtttatgctcacagcaccaacgattatcggcaccagcgttctattcttagccgtcgccatcctaagcgccctattatcccttattcaagtgattcggattgacccgatcacagctattggaggtcattaatatgtcagcaccgattttaacactcgaacacatcaccaaagattatcccgatggtgaccaaattaatcacattttaaaagatgtctccttcacgattcagccaggtgaatttagcgctatcgttggtcccagcggtgttggtaaaagtactttgttgacgattatgggcgcgctcttgcaacccacagccggtcgtgttaccttggccggtcaagaacttgcaacactcaatcgtaatcgtcaaacacaaatccgccgcgaatcaattggttttatttttcagagttcagaattaattccctatctaacggtcactcaacagctgacttttttacaaaaaatcgcccgtcgtcgcgatcaacccgccgctgaacaattactgacacaacttggattaggccatcgattacacagttatcccgccatgctttctggtggtgaacagcagcgggttgccattgctcgggcacttatcaatcaacctgcactcattttagcagatgaaccaaccgccagtttagatgcgcaacgtggtcgtgaaattgtccacttaattcgcgatgcagttcatgaacaaaaacgcgcagctgtcatggtaacacatgacgaacgggttttagatctcgtcgatcacgtttggcgtatcgaagacggtcaactccgccaaaccacataaaaaaacggtcctttcacaacttagcgttgtagaaaggaccgttttttagttccagaggatagctactattattcgacgttttcaaatttaccccacaagttcattgtggattgaatattaacaaaggcattcggatcggcatccttaacgacccgttttaattccgttagatcgtattttgaaacaactgtcatgatcactgttgtttcttggttggtatacagaccggttccatctaattcagtcgcagcaccatgaataaagtcacgcattcgcttcttcaattcttcaggtcgcttggtaaaaatcgtcacagtcaccttttgttgttgaatatagatataatccatcaacaagcttgaaacaaaaatttcgacgatactgtataaggcagcaccccaaccaaagaagatgccggctgcaagaatgatcattccgttgatgatattattcacaacaccaacccgtttaccagttaagcgcccaactaacgtcacaatgacgtccgtgccaccagttgaaaaacccgctttaaaacacaagccaacccctaaaccaatcaatgcacccccgaacaaggcacctgcaaatcgttcggtgacaattgggtgaacaggtactggaatgaccttcaagaaaaggacactcgtaaaaacagcgacgatactaaaaatcgcgtactgatgattaatcttgaaccatgccagaatcaataatggcacattcaaaataaagaccaacatcgcaacacttaatgagtcgcccatatagctgactaacgaggttagtaattgggcaatcccagtgaccccactcgaatacgtcttcgctggaatcaagaacagattaacactcaccgccgccaaaaaaccgtataccatcgcgataataatttttttcgaatttccttttaaagcaatcactgtagcacctccatcgattaaaaaagtcacactccccccttggaagagtgtgacaaatgattaaagtgcgcacttggctataggttcttatccatgacgaaggtcaacttagaaagttgcgttccttctgtcaccaattgcgctaacaaatcggttgttgcttcatggtaatgtgcagcaatttcatgattttgctgggttaagaaatcagtggcattcgcttccgcctttacagcagcatccaccgtagcaatcttagttcttgcccattctgataatgctttttggtagtcaatatcagctttcttaaaggccccgtagtgtgattcaacaatcattgctaatgcttcatataaccagtaagcgttcttcaactgcatcttcgctggtagttcgcgataactttcatccgtatccatcgcattcgtaaagaatggtacgtgtggacagaatgttggtacccccaaacctaaccattgaacaccacgcacagcatctggcacattgtttctaatctgacagatatgtgagttttgcgtccgtgaaagtgaaattgaccgataaatcgtcttttgttcttctgtcccattaccaagtggatcgtaaatagtttcgttataatgtgattttaacacatattgaacatcttccacacttattttacggttagccttgcgaatgaaaggcaagtcactcgattcaggttcttgtttgatttcagggttcaaatagcgttgtgcataccaaacccgtggtgtgttatagtgacgatctaattcagtatccgtcccaaaaatcttacggaagttccattcagcttcactcggattcaagtgattttcactgacgaattcttgaataccttctgaccacatgtaattttctggatcattaaagtcgacatcttcgatggcaatttggttagcggcaactgcataacaatcatccggaatccgaacagcaacccagtgatgcccagtaacaatttcttgataccaaacttcattttgatcactgtattgaacgccattgccttcagctgaaccgtatttagcaatcaaatcccccatcaattgaaccccttgacgtgcagaatcgatgtatggcagaaccaacgtacacattgaatcttcagctaaaccttgcttgaccaacggatcataagctaatacccgttcgttggcataaacactttcagttgcggaaagggcgacatttttttcattaatcccgtcttcttcatttaaaccatcacttaaatcgccgttgcgggttgatgtgtaacgataaccgtccgtcggtaacggcatggttaagccgttatattttgaaacatatgtctcatgtcgatcatgaactgctggttgtacgaagaaccgtttaggatggattgcatagaagcgatcctcatttcgcgaaatcatcgtagagccatcaattgacgcattcttccctaccatcattgaagtacatgctgataattcgattctgtctgtcatttgaaaaactcctttttattaaaaatgtgattcactaattgattaataaaacttagtcggttacccgccggatcaaatgttctgtgtgttctagatgattcaaatacacgagtaatcgttcatacaggtattcaccggcttcatcatactgtcctgccagtgcttggccaatctggtggacactgcgttttccattcacatgcctaaagacaaaactaccataatcatcaagttccagctgtgtttctagcggaatcttcacatgcaaacgccgtaatgtccgttgaatccagtgattctgcggccgaataatggtgacctggccagcttgtaacttaaactgaacttgcggatttttttcatagatgagttgttctaaatcaatctccgctttctgtcgtcccatcttctgttgcccctcctttatgaatcatcataagtggcacagtaatcgaaacaaccatgacaaccaataagataatccccattgcattggtattcgcaaaaccagtaatcacgcgatcttttaacacaccggttacgtggagaataatcccgattaaaccaataattgaaccaccagcaattaaaccggatgataaactaatcccactttgaacccgattattcttaatcgcttcatcacgcgttgctttttcaataaagactttaatcaaagcaccgatcaagatgattgaagtggttgaaattggtaagtaaaaaccaattgcaacggtcatgattggtaaatctaaaaagtagaaagctaatgccatcataaccccaacgataatcatgatccatggtaatttacccgtcataatcccagatgttaatgtagcaattaagttcgcttgtggtaacccaaaggctggtgttgcactatctgtaacgaattgtggtgataagatgctgattgtgccgacagttacgattacgccgacaatcccggcaatcatgaaatatttcatcatttcagattttgaaccaccaatgacatatgttactttttgagattgcatgtagccaccaccaacagcaacggcggtcacaacgaatgtcccgaacatcaataagatttgcgtatggttattgtccgtccaaccaaataatacgaagactaccgtcataatcactaatgacgcaattgtcatccctgatacaggcaagttagaacaaccaatcgtcccagcaacccgggctgaaacaatgacaaagagtaaacttaagatggctgctagtaatgcaccaacaatccccattaagaagttttgcgcaatgataataccaataacgaagatcccaacaccaccaacaacaatggcaatcataccaagtgtattcttttcttcgcctgctacgtttttagcagctagtgttttcttgattgatgtcacgatagttgggattaatttaatcgcaccgattaaaccaccacaaagcatcattccggcaccaatgtatttaacgtatgaacttgataaatcgttaacggccatttgattcacggctaaactcgtgttattccaaacatgcgcactgttgcccgccatatctgtgaaataaccgattaacggtgcaatcgcaaagttggataaaatcgcacccgcaaacattgttaatgacacttctaatccaacgataaaaccaattcctgcaagtaatggattcacttcaacgtccaatttccatttataaaatgatgaaccaacgtagctaatcatgttgttgacgacaccaaacactgatgaagttagcatcgtaataaccccaccgataccaaagccaacgcccatgtatttaagcgaatcgccaccagtatctgacgcaactaaggtttctgaaatcgccatggcttctggataaaccaacttaccatgttcttcaaccattaagtagttgtgcactaatgaggctgtccccattgaaaaaagaattgcgagcaccccaacgatgatcccttgaatgaagttgatgtggccaccaattaaaataatagctggtaaaacataaatcatcccactggcgattgattcaccaccactggacatcccttgcataatattcttgcctaaaatcccttttgatttggcaaaggcgccgactaacccagacccaataattgaacctggaatcccggctgcaacggttaaaccggccttcatcccagaataagctgttgaagcagcaaaaataatggctaaaatgctccccattattagaatcgctaagttgccgacctttttgtcgccttggttgacatacggtacatatttctcacctgaaacaccgccgtatgcggattttgaaagtttcttttgcatgattgctcctcctaaaagtcgcttttatttaaggctcttatccttaccaaagatttgcatcttcaatgcaaccccggttggtgtagcagctaatccacctaaaccagtttcacgtaatgtagatggcatatcttcaccgattcgtttcatggcaccaatcacttcatcagctggaatcttgctgattagccctgccaatgccatatcagcactggtcaaggcatcgacggccccaatcacgtttcgtttaacacatggtatctcaactaatccagcaacgggatcacaaaccaatcccaatagattagacatcgccatcgcgaatgcttccgacgattgttgtggtgtgccaccagcagcttcaactgcagcggcggcgcccatcgcggcagcactccccacttcggcttggcagcctccagttgccccggcaatcatcgccttattggcaacaatcatcccaaaggctgacgcacaaaacaagaaccgaatctgcgcatcccgatcaagcgccaagcgctcagtaataacagataaaacaccgggtaaagtacctgctgaaccagcagttggcgttgcacaaatgatccccattgaagcattgacttcattggtagccaccgcattttgcatagcggtcaacatcacatcacctgataacgactttcccttttcccgataccgcttcaacagaaccgcttcaccgcctgtaatcccagtggcagactgaacaccttcaccggtcacgcctttttcttcggccgcaatcatgacatccaagtttttccccatggttgcccaaatgacctcacgactagtgtgactcatcgcaacctcttgttcgataatcaattccgagattggtagttgccgttcttgcgctgtctcgactaattcgtgaattgttgtatacatcttcccaccactttctataacacaataacgtcttggctcattccgcggacctgttcaatctgttccgggtacggcttatcaatcagttcgattttatacaaaaaccgatctggcactttaaccgatatgcgcttatcacgatagttaccttcaaatatctggtctaaagcatcgccgatttcttgttccgattcgacaaaaaccaatggtaacgggccatccgttttaatcacaatgccattcaaattgacttggcggatttcgatggtcccgcccccaattgaacagccccaaatcgttagttccttctcacgattgattaacgttaattccgctgtattgggatggtgcaccggactattccctggatcttcaatgaagacaacgtcaataccttgacgtcgcgctaaatcaactgccattggtaccctttgatcggccggatcgaatcctagcacgccactaataattgcataatcggtaccatgcccttggtgggtttgtgcaaaagattcgtagtaacgcacaataactttgttaatcggtgcatgaaaaagacgattagcaacatgtccaatggcaactgcgccagcagtatgtgaacttgaaggaccaatcataatcggtccaatgatatcaaaaacgctccgatattgatttgtcatgttctcctcctactttctgagatagcattaacaaataggactacttatccaataaatcacaatctctatatctgtaccataacacaaaacaaacacggcttcatgatattctaataagcaactttgtgaaaaaatgagaggattcttagatttatttctaaaacgaatcccataattagctttgcctatttaaaggttgccatcagccactttcaagattatataccctaaagcacactcattttttcgcaaggtgccgaattttattgtactacaacacaggtttttaaatccactatctttgcgtcactgttcaataactactataatggacagcacacacatttatattggaggttttactatgcggatttttgttattggcgcccatggtaacgttggccagctcctaattagccaactcgttgctgccggtcacaccgttacagccggcattcgtgtcgaacaacaggcggatgaacttgcacaactaggggccatgcctgtcttattcgatttaaccaaacaacctaaggctttagcaccactatttgccgatcatgatgcgattgtctttacagctggttctggcggtaaaacaggcgatgatcaaacactgttggttgatctcgatggcgccgttaagagtatggcagcagctaagattgctgaagttagtcgctacgtcatggtcagtgcactctttgttgaggatcgaactaaatggcctgaaagtattaaaccgtactacgctgcaaaatactatgccgatcactggcttgaattctctggtttagattggaccatcttgcgtcctgggacacttacaaacgacgaagctaccggcctagtgacaatgcaaccatctggtggacaagttgcacgtgctgatgtcgttgcgatgatttgcaccgtcttagaacatccgaccgaaacaatccacaagaaattctcgtttgttaacggcgacttgcctttaatagacgccatcaaaaaagcagactaaattagtctgcttttttcgtagtcttttttttggtggttgttttcttagtcgttgttttttgggtagctgtctttttagctgttgtcttcttggcaggcgcttttttcttagtcgttgccattttcttaggtgcggctttcttcttagcgggcgccttcttttcgactggttcttctttaggcgcctgtgaaccgattacgacggcttccaagtcctttgttagcaagtcggcaatcttcgtccaattagcagctgccgattcttcaaacgaagctaccgtcccaattaagtcaatccgcatgttcgagcgattaatgagtggcgatgtcacatataaataaagattcacctctgcttggtcgtcgagttcaaaaaattgatttacttttttaatgtattgtaatggtagattcacaatccccgtttccaatgtcaccttaacgggttcgccagcatattctgtcagcaccgaaaaagaggccaaagcttgtttttcaatggctttatcaatagcgggttttaactgtgccaaaataccgtccgccacaaaaggatctggcgtggggagctcgtattcatccgttaaatatgtttgatcttgaatttgattgataaatgcttgtacttctatcttcatctcgtcagtccttttttaaatctctacatatcatagcttatttagggctaaaatacaaaaaacatcccacctaggtgagatgttcgcttaattgcaatcattaaaagacacggcgtgcaaaacttggtgcatagtattgcattgaaccgatcttaacgttttcgccaggttgtggggcatgaatatattgtccgccaccaatgtatagcgcaacgtggtatgagctaccttgtgaaccccagaataataaatcgccaggttgcaagttgcttaatgaaacagcataaccggcactttcttgagggactgtccaaccaccgatactcttaccagcagcatttctgaagacatagtccattaatccagaacagtcaaaactacttggaccatgggcaccccaaacgtaaggtttaccaatttgagccatcgctaaattaataacagcttgcgcattaccagtcgttgctgcaggtgccgttggggctggtgttggtgtcgttacaactggtgccttttgagttggggctggtgttgtttcaactggtgcagtttcttggacaggagctgatgattcttgagtagctggttgttgtgtttgagttgtactttctgcttgagcaggcgcactactttctgctacagctggtgtactttctagtgtggcagacgtttcaactggtgttgattcactttctgcgacaggtgctggtgttgtaggcgtgctttctgtttgcgcgggtgttggcgcagctggtgtttcaacaggagttgttgttgcaggttgtgctggtgctaccggttgtgcaacgggcgctggtgtggcttcaatcttaccatcacctgtaaagcgagctggtacccagccgccattttcaagttgataccattcttcgccagaaacagtttctgttttcacaacgttgacggtttgaccataacctaagtattggcctgttggggctgtataagttgctgttgaccaagcagttgttgcgccaccggcataggcaatccgagctgtcttttgagcagcaggtgcttctgttgctggtgttgtttcagctggtgtagcgtcactggttgttaagtaacgttcaggtacccattcgccgttcccaattcggtaccatgtttcagcaccaatcttttgtgatgctaaaagatttactgattggcccttaaagatgtatcgtttagcagtttgaccagttgttggacttgtccaaacagttgttgcaccatctgcatagttgacggttgctgtcgttgctgcttgtacttgccctgcactcaataaaccgatcccagctgcccctaaaattccagaactcaatgcaatcaaactctttgtgttgttcattaaactgtctcctgtcgataaattttttatttgtgttttcttaatcatcgtaattaattcataactaactttgcaaaaatttaatttctaaatgcaattttagcacagacccgagtaaacattcaagtaaacactatgaacaactgtttaagcatgcaacaaaaaaagcgccactacacggtttgtgcggtgtcactttttttaaattaatgggcaacattgccggccacattcagtgcatcccacgttcttgcaaacggtggtgcataaacaaggtcaagtaacccaagttgttcagttgtcatcttcgcttggatcgcagttgcgagcacatcaacgcgcaacactgcgtctttttgaccaaccacctggccaccaattaagatatgctctgctttggtgtaaatcaatttaatcgttaaatctgattggcctggataataattcgtttggttcttgtcgtggattaaaacagtactgaaatcaataccagcctctgtcgcttctttttcagtcaaacctgtgcggcccgcttctagcgtgattaatttcacaccagctgaattcaacatccctggtaattgagcggcttgcccgcctaaattcgtgccgacaattcggcctaatttattggcaccagtggcaagtgctgaatacatcggttggttcgtcacgctgttaatgaccgttgcattatcgccagcggcatagacattttcaatcgatgtccgccctgcttgatcgacaataatcgcaccatttggcaacttcttcaatcgatcatccgtgatgaattgcgtattaggccgaatcccagcagctacaatcactaagtctgtcgcatactgtcccttatcagtcacaatgccagtcacctgatcagttccttctaaggcttgaacagcttctgataagtgtaattcaatgccgttatcacataagtcatccgcgaacatgtccgttagttctggatcaaaagccagtggtaaaattcggtcttctagttgaatgacccggacttgcttccctaattgatggaactcttcggcaatttctaacccgataaagcccgcaccaatcaccgttacagattgaacctttgggtcttgtcctaattcacgtaaggcttgtccatctgccatcgtccgtagatgatagacgttttttagatcaacatttttaatcggtggcatcacagctgtggctcccgttgctaacattaattgatcataagattctgtgcgatcttgattggttttcaaatcccgaaccacgattgtttgcgcatcaaagtcaactgatagtacttcgtgttcaagcgcaatatcaatgccttgttgcgcaaatttttcaggtgtccgggcaatcatttggttgggatcttcaaagtgctcgccaacaaaataaggtaagccacaagccccaaaggacacatagtcccgtttttcgtataacgtaatgtctaaatctggattcgttctttttgctttcgcagctgcacttgttccggcagctgtggcaccgataataatcgttcgcatcactaaaccctccatttttttgaaattaagccatttcgtctgaatcttccgtcaaactcatatcattaaacttgttcttatccagtttacctaataagtgagccgttaaaaccccggcagtcattgagccatcaacgttcaaggctgtccgacccatatcgattaatggttcaactgagattaatagtccggctaacccgactggtaagttcattgaagaaagcacgattaaagcggcaaatgttgcgccaccaccgacaccagcaaccccaaaggaactgattgcaacaatcaagattaatttaaccaagaaaccgatgctccaaggattaatcccaacagttggtgcaatcatcacagctaacattgctggataaacacccgcacagccgttttgaccgattgaagccccaaatgaagccgataagttagcaatcccatcttcaacccctaaacgtttcgtttgggtttcaatgttcattggaattgaacccgcactcgtccgtgacgtaaacgcaaaaattaacgttggaatcacttttttaatgtagttgattggatttaacccagtgaacgtgattaataggaagtgaatcaagaacatgatgattaatgccacgtaagaggcaatcacgaactcacctagactgagaattcctttaacattagtttgtgctacggtcgttgtcattaaggctaacaccccataaggtgtcatccgtaaaattaaagttaccatgcgcatgataaccgtgtacaaggcgttaacgattttattaaacatttctgcttgttccggctttttacgccgtaattgtaatgctgccactcctaagaaagctgagaaaatcacaacagctaatgttgatgtaggtcgtgaacccgtcatatccatgaatggattttcaggaatgaagctaacgattttttcaggaacagtttgttcctgtacatcgcctagcttcgtttgtaattctttcgagcgggccttttcgacttggcctgattgaatatcactcgcatttaagccgaaaacatccgctgtcactgaaccaactgtggctgcgattaaggttgtaaagactaagattccaatgaccatgccggccatcttccctaagcccttagatgattccaagttcgtaatggcttgaataatcgaaaccatgactaacggcataacgatcatctttaagaacgagacataaccgttgccgacaatgccgacccaatcagctgtttgtttgacaaccgttgaatctgttttgaagataatctgtaagagtgcgccgaataaaatcccgacccccaatgccgtgaaaacgcggcgactaaacttaacgtgaatccgggccatcttgtttaaaacaaataacatgatgagcatgatcacgatgttgatgacgacatatgtaattgtcatttctttaccccattccatttttaatacttacttattgtaaacgatagtgattatttttgcattagataagccctaattctcataatttatttcataatggtaattgcctagtgttaactcacgataaaataacagttttatttcagaaaaatgggttattaataatgcatgggcttctttcaacaaaaaaaggcgcagacaaaatcaatttgcctgcgtcgctattcatgattatgctaggtcatccccattggtggcgattaccttttggaaccaatagaaagagtccttcttagaacgagctaacgtccccgttccgtcgtcatttttatcaacatagataaacccataccgcttcgacatttgtccggtgcctgctgaaactaaatcgatacagccccaaggcgtgtaacccatcagatcaacaccgtcatcttccacggcttttttcatctgaacaatgtggtcgcgtaaataatcaatccgataaggatcgtgaatttggccgtctgcttcaacgtgatcaacagcaccaaacccattttccacgataaattctggtaagtgataatgatcattgaaccagttcattacataacgtaggccaactggatcaacttgccagccccattccgatgccttgacatatggattaggtactaaatcgtgttcttcatcataatgaagtgttgtttcacctttgtccttggttgcaaatgacatgtagtaactgaagccgatgtaatcaactgtccctgcagccaattctttcaaatcatctgcggtaatgtccaaatcgtagtgttggttcttttgatattgtaagagccattctgggtagcgcccatgacagtgtacgtcagcaaaccaataacgggtttgcattgcgcgttctgccttgagcacatcctctggtttagctgtcagtggatagatgggacacatcgcaatcatgcagccgatttcgaaatcaggattgatttgcttgccaatttgtacagcttttgcactcgcgactaattcgtagtgggcggcttgatacatcactttttcagcatcttcaccaggttgaatctgtaacccagaatttgtaaataaggcaaactggctgtggtaattggcttgattattaatttcattgaacgtcatccagtacttcactttattacgataccgtttgaagaccgtttcagcaaagttcaagaaaaagtcgatgactttgcgattacgccaaccaccgtattccgtgaccaagtgatatggcatttcaaaatgcgagagcgttacaactggttgaatatgatatttgagacattcgtcaaataggtcatcatagaatttaaggccggcttcgttgggttgtgcctcatccccattgggaaaaatccgcgtccatgcaatggatgttctaaagctcttgaaccccatttcggcaaataacttaatatcttctggataacgatgatagaaatcaatgccttcgtggttcggataattgtgccccggttgtacaccatctgtaatccctcgttgatgattaacatccccggcagtcatcacatcggccacactaatccctttgccatccgcttgccaagcgccttccaattgatgagcagccactgcgccgccccataaaaaatcttttctaagttgtcccatgttgacctttccccctatttagttgctgcaccttgttctgaagcatagttcaagtgatcttgtttccgaataaatggtaagtacgtaaagaacgtcattaataacattaaggcttgccacaatgcagtcttccaaccacccactaataacccagaaatgattggtggtgtcgtccatggtaccaacgttccggggaacattgggattaaaccgacccgaatcgcagtccacgttaagattgctgatagcattggtgtcacgaagaatgggaccatcataatcgggttcatcacgattggtgtggcaaataaaattggttcgttaatattaaagatcgctggtgctaatgataatttccctaaatctttgaattgtgctgatttggcaaagaatgccatgtaaacaacaatcccaattgtcatcccagcaccggtcactgtcataaattgatcaagtaattgttgcgtcacaatgtgaccaccgttagctaacgttaatgctttgcctgaatccaagattttttggttagccagtgagttggcttgcagtaaaggccccataatcccaccaacaattgttgaaccatgcaccccgaagaaccacaagaatggtactaagaaagaaatggctaacatgccaccaaatgaatcggtaattccttgaagtggtgcttgaatggcattgtaaattgattctgttaaggttgagtttgcaaccttgtcgaagaagatataaaccaagagtgagccactaattaaaacagcagctggaatcaaagcggtaaaggaacctgcaacgttcgcaggcacttgttctggtaatttaatccgaatatcatgttttaagaaagctgagtaaatccaaccgactaataaaccgacaataatggcagtaatcatcccttgtccaccaagccaagtccgatcaataaacccggtttgttgactcatcattttaacagagacaacaatcttaccggatgccgaaacaatggcagtgcttgggcgcgtcactaataagaaacaaacaatagcaagtaatgaggctgggaacggatcaaaaccttcatcctgaacccaagaataagcaatccccccaacggcgattaacgccataattgcaaacgatgcgttataggcaacgttccaatatggggtcaaaccagttgaaaccatccaatcggcccaactcttaacaggcaagttggctaaaattaagaaaatcgatccaacgattgtaaatggcatcacgtatagcatcccatttttcaacgctgtaatcggccgcgtcgcaacaaacttcataataggtggcattaatttagtattaatccaagtattcatgtgtttaacttcccttcgctatttaatcacggcgattgatcaacatcgccacttcagaatgcgcttccataattgcagtatagcacgttgccatctgggcgactagtcctttaacggtgataaacacatgcaccactgattggtatttgtttcttaaaaaaaacatgtttcaaacaacacttactgagcgcaagcaacgcgatgtgctagcaactctagaatataaaccaccggtatctgcgtcgtattattcaaggaaccattcttttcttcaggcatataatacggaatcacaacgtccgctaaccgcgctaaagtcgaatgcgtactgttggtaattgccaatactttcccttttcctgcttgatattgctcaacttgtgccaacatttcagttgtttccccggacaccgagagcaccactaataaggtatccgccacgactgtttctcgcatccccaccggtgtaaatggatcattgatgctcagcgagaaaataccagcgttggcaagataccgcgaaccatactgagccagtgcgccactagtgccgatcccaaagaaaaagacagcttgtgcctctaaaattaatgccgttgcttgtgataaaagctgtctgaacgtttcgttattcgttttatccaaaaactcggtaattggcaacatgacatcatattcaggcattgatgtctttttttgcgccaaccgctcttgctttagcatatacttgaattccgaaaacccctcgcaccctagcttctcacaaaaccgcgagattgttgacgtcgatacatgcgcttgggtcgccaactgacgaatcgtcattttttcgacctgtgcgcgatgatttaaaacatactttaaaactgatagctccaatgtattcaactgctggattttttcaagttcaaacatttactaaccaccccttgctaccattctatcaatctttacagattatagcgccttttaagggattaaaaaaaagattcgctgctcgccaatccttttttggatgatcactacatctttcgaaccacttcatccttaatcgttatgccttctttttccaaccgtgcaatagtgtctgcaaactgaggtaagtaagccttatgcgcaatcagtagttcatgcatgacgcgcgttgcggtttcaccggatggcaccaatggattgctaataaaggcttgtaaagctgtgccataatcacccgttatcgcagcttcaatggttaacaattccattgatttcatcatctgtaaccaaccacgttctgctgttggcaatggtccaaacgcaacattccgcgcaccagccccaccaacataggccgtcacttcaaccgcacaatccgctggcaaatccgggactgccccgttatttcgcgttgaaaccacaatttctgtattcttattcgcatagatcgacgcaatcgtttcacaggctgcatctgaataataagccccccgcgttgttcaagttgtttaggtttgtaatctaaatcagggtctttatacaactcgaacaattcgtgttcaatgactttcacctgctgcgcacgcgtaccttcagtcgcatattccgttaaaccatgctttaacatttcttcagcacgatagtaataacgatgatagccacacgggatcatgttcatttgctgtaactgttcccgatagaaaggaacatcaaaaatatttttcggtaacccgctattttcttcatataatttatcaatcaattgcggcgttaaatcatgaccttttttatcagctactttatgccagtgaaagtgattaacccctgcaaatttatagattaaatccgtctgtggcacacctaacgtttcagcctctcccatcttagcgacgaccggcacattacacaaaccaatcaccttttcccattgaccgtatcttaaaactgcctcggtaaccatgccacttgggttagtaaaattaattaaccatgcgtcaggacagaggcgcttcatatctgcaacaatttctaaaataacgggaatggttcgaaatgctttaaacatcccaccagcgccattagtttcttgccccaatagaccgtatgaaaatggaatgcgttcgtccttcacccgtgcatccagttggccgacacgaaattgcgtggtcacaaaatcggcgtctttaagcgcttcttcacgattcaaggtcgtatgaatctgaacatcatacggggacgcatcccacattcgttgcgccattttcccgacaatcgcctgcttctcagcacctgcttcaacatctactaaccagatttcaccaattggtaattccgcatagcgcttaataaacccttccatcaattctggcgtgtaactactaccgccaccaatcgttgcaatttttactttccgtgtcatctgaatgcctcctttgatttatttacaaattaagcatacctaacgcaaaccgcaaaccccacctttatgccctcgtttaaaagtgagttcgcataaactgccgatattaatggcctaaacgcgaatttaatttacaaatcactagggtatcgattgacttattttacaaatatcgctaatcttttgtaaaaggaggcggttacatgttaattaaagaaaaactagagacattcgcgttttcccccgctgaaaccgtggttgtggattacttgttaacggcttcagaagcactcgatcagctttccatccaagaaattgctgctcaaacctatacgcaaccgtccactctggtccgcattgccaaaaaactccattttgacggttggaaatcttttaagaaacactatctagaagagtggcgctacctcaataaacattttacgcgtatcgatcccaatctgcccttttcgagtacggatagtttgatgaccatttgtaagaaaatggcggtcttggacaaaatgacgattgatgatatcttctttttactcgaccaagaccatctgagtcaagctaaatcattgctcctcaaggcaaatcatattcaaatcttctcccaaaactcaaacttactcatcgcgcaagattttgccctcaaaatgaatcgtatccaaaaaaacgttacgctatctgcggttcgtggcgaggaaaactacgatgcctataatcttagtccggatgcttgtgcgattttaatttcctattctggcgagaatcccaacttactagcacttaacactattttacgcgcccgcaacatcccgacgattgcgattaccagtatcggtgaaaatcgactttcgcaagaatgcacttgctttttaccgattacaacccgcgaaaaactctactcgaaaatcggcaactttaccattaatacctccatcatcttcctattaaatgttttatacgcgctcgttttttcggaacactacgatgcacatctcaaacatctaaaacggattggtgaattagtcgaccatcgcaccatcagtaacgctgtcatgcaagaaaatgaacgcacaaaaaaagccccttcctgacggaaggggcttttttcacagtattccgaagaataaacaccttgtgctccacaacacagcgggcgaaaacacccttgcaatacggcaagtggttaaatgaataaccgtggtatcctgtatctttgggtctcctagctgccttcgcagaatagttgcctaccgagacttactcgactcatcgcatgaacttattatagcatactttttagtgacgcgatacccatttcggcgtaatcgctcgttttcgtgttatatcggctaaaatttgcgctaacataaagccaacggcaatcgcaccagcaatcatgattactgcaacaccttgtgtcgaagcttcatttaagttgcctagcacgaggtttcgaatcgcaccatacgcagttccgccgggcactaagggcactaaccctggaatattaaagataatcaccggcatccgcttataacgggccataatattgccacaaattccaacagctaacgcacccaacaaattagcaagcatccgcccgctaccaaagttaaagagcatccaatagacctgccaccctgccataccggcaaagccacaccataataatgcgcgtcttggtaaattaatacaaattccaaacgcaaccgttgaaatataactaaataacgcttgaataataaactgaacccaatatggcatctgatgaacctctctttacataaagaatctaaatacgagcgcaatccccgttccaattgcaaaggcactcaggatggcctccatcccacgtgccataccagataataaatgccctgctagcaaatctcgaatcgagttggtaatcgctacaccaggtaccaatggcattacagccccaatgataatattatcgatatcgactcctaagtaccacctagttaatagataggcgactatcccaatcactgtcgcacttaaaaattcaccgataaagcgaatcgttgtgacccgattgaccgccgcaaagacggcatagcctaaagcaccggctaccgctgacggtatgatatctaaccaatcatattcaccagaaaaaataatcatcaaaaacgctgaaatgactgctgcagctgtaatttgtaaccacaacggaaaatgagctgtatcctgatcaatttgttttaaccgtaacattaactgatccaacgtaatttccttagtcgcaaattgccgtgaagcagtattcacattttcaactttttcaaggttaatcgtccgcaccgcaacagcgcctagttgcacataaggttgattttcaattccgataaataaaccggtcggtgtcgtaaacacaacactcttttgaatgcctgcattataagcaatccggttcattgtatcttcaacccggtacatttcagaaccactttcaatcataatccgtcccgcaattaggcaggtttctaatattttatttttttgggcaattttcatggcaaaacctcattcgacaacttttttcattatctccatcataacttgtttaaactgaaatagaaaccatttacatattaaaaattgctcatatatcgccacaaacccgacttcttatgttagtgtaactaagaagcaacatgaatagtaattaattaaattcgttcggcgctagctacgttttcaacgggctatttttttgcacttttttatttaggagggtttattaacatggttttaacaaaaaaaagaacactatggttatctgttttacttggttcactgagtgcttatggacccctactagtggatatgtatctaccagcatttccgattatggaagctgattttcattcatctgcttccatgattcaactgagtctaaccatgtgtttggctggacttgcgattggccccatcttcatgggtgcctggagcgatcgtgttggccgtaaaaagccactcgtaatcggaaccgcccttgcttttacagcgtgtctattatcgttagtcacccacaatatttggctattcttccttttacggtttattcaagggttagcgagctctgcaggacaggtcattactcgagcagtcgctaaagatttatttgacggtaaacaattgacaaaattcattgccttactcatggcaatcaacggtatcttccccatcatttcaccattaataggaagtgctttgctccgtttcacctcttggaaaggcattttcggctttttagggattgttggccttcttctattgttaggcatcattttggcattcaaagaaacacacacagtatccacaagcgcgcaatcggcacaacaatcgcgccttggtattcaagccatttttaaagatcgcccattcatcctatttgttttaattcaaggcctcgtttatggggcaatgttctgttatatttcaggttccagtttcatgcttcaaaatgtctttagtctttctaaatcaactttcagtctaatctacggaatcaatgggattgggattatcttaatggctgaaatgtccaccattttaatccattggtttgatgaattacaacaattaaaaatcggcttaattggtggtttaatcggtgccatctgcgtcttaattagtggctttggctctaatcatcgtctctggttagctttaattggtttattcctagtggtcgcaacacttggtctaattaatgccgttgtcacctcactggccttacaacgccaaggacaacatgcagggattgcttcttcagtgcttggacttggcatgtatgttttcggcatttttctttccccattagttggcgtgatgggcagttatacctatcttccattagctgttttgattttactttgtgagattggcgcattaatcctttatcaacgtgttatccacatggttcgtcaataatcatctcccccttagacaatagctaagggggttattttatttctacttatcaaaaaagacccgcaactctccaatgaaagttgcgggctactattaatgcgctgattacatttcagcgattttcttatctaagtatctttttaacttctcttttggaaaagcgccagttaccttttctgtcgcctgaccatttttgaagattaatagggttggaacggattgaatcgcatattgttcagctaacgctgcttgatcctctacatcaacggttcctaagccaaactgatcagctaattgttcatgtagttcagtaatcatcggtgtcataatccgacaaggtgcacaccaatccgcccaaaagtctaaaatcactaacggttgtgtttgaacaaagcttgcgatgttctgttctgttacggtttgaatcatgctgatttctcccaacttattatttaattactacaaaaaaggttgaacctttcggctgattataatcagcatcccaaagctaagcaaactgatcaccgtccctattctctgaatcgtagttgttcgataataaacggtgattctaccagttcccttcagcgcaacttgtgttaacccagttcgtttattcatctgcattggtaatcgctgatgatggttgagttcggcaacgtaccctttgtaataaataaaggggacttcaacaactgctttttgatccgtcagtatcctgaaatcaaactgataacggccccatgtatgccgtacatttgtaatttttattttatgcggctgatacttaacgacctgttttttatgtcgcaaaattttctggtagtcggtttgagcaggtaaatactcatgtccggccccaatgtaataagggttgggcgtgttataggcagcattggttctaaagcgccaactttggttttgaatactattcgtagagtagatgacatttcctgcgcccaacaacagaattagcagataaaagtagtacttattctttaataaatgacattcatccttagcaactaagtaactcacaattgccgtaataatggcaaaaaaacgccacgggaactgaatcgtattgataattgtatgatccaacaaatgccacggcataatcggcgtcgcagctatgaatagccccaacgcaatcccaattaaatcacggtcgtttttggaatagtaaaatagaccacatgcgatgcctaatccgagtaaaatcgtgataccgacattcactgtatttgcatgaaaaacagcattcgttaatgaattaacaacaatgtctttaaagggtaatgtgcggtcagataaaaatgccaggggttgtgcggttacttgaaaaatcgtggttgccatttgttctccaaccgctaagaaataacgccctaataaaccgattgctaataagccagcagcaatgagatactttaaacttttattttggtagaatctcttgagatttaataaggtataaataatgatgacaatgcccatcatttcaacagaaatcatatgactataaccaatagctgccatccctattgataacagataccaataccggtgctcacctttttttaaccgcgttagcatcacaatcattaatgggaaaaaggtgagcgcgatcacctcaccaatggcttgccgattaactaaatctgcaaaacgataaatactaagaccgtacatcaaagagaatattaatgcttgcttcttattaaaatccgctaattttcctgaaatatatgtgattaaaaacgtactaaaattaatcgcaattgcaaatacaataaaactctctttgattgatagtcctactactctcagaatagctggtaagtagagaaaagcatctgggtaaaaaagacctgccgcatagcccattccgccgatgaaaaagtaactgattctcggaaaccactctccctgtttaatcgaaagtgccaaattctcaatgcggtgatagtcagaaccagacaggattttattgggctgtaaatagacgattgcaaccatcgcaatacttaatagtccaaaaaataatagggttactgttaaggcatgtcgcctgtaaaaatactttaatctttgcatcatacactcctcataaaaatactttagtatcgataattgccattccagcatcagtctaagggggacgatcgaattataagtaagtataaataatgtaataatggacattatttatatataaactttaacgaatagaatcggtcaatgtacaatattttgtttggcaattaataaataatccataagctaagaaagcgataagatgcaaaaaagcgggctaaataattattagcccgctttaaaatccattaaatttataaataaacattttaataattaaaagcgctttattaaaatattcattgtctattttctcgcgattacacttttcatccaatcaaaaaacgcccgcctttcagcgcgcgttttttctatttaattaacgtgtaatcatccgcatccacattatcaatcaatggtgacatgccacctgttgctaataaagtgaggcgatgcatcgctcttgaacagatcgtgtagagcaattgccgttgatcttcatgattgtagttggttgcgctgacttgccagccgataatcgcatcgaattccaaccctttggctaagaaacttggaacgactaacgtgcccgctgccaaacgttgattttcggaacgaattaaagtgacttttgtaccactggctttcaacttagcggttaattcttgggcttgcaccaatgtcttggtgataatcgccgtcgttaacttatctgcttcatttttagcgagttgcgcattcacatcagcgaccaattgatcttcgctttgacgcacgatcaagtttggcttgtcgccttcacggttgaaggcttcaattttttgaccgccctttaagaggcccttggtaaagtcggtgacttgttcagttgaccggtatgaacgcgtcaattgaacgaccttcgtattttgcgcatcaaagagttgttgcacttgttgtaataggttcgtgctgttttctttggtgaaaatcgcttggttcaaatcaccgagtaacgtgaagcgcgccttagggaagtgcatcttcaagaaggccagttcgtatggtgtgtaatcttggatttcatcgataaagacaaagcgcatgtcgcgttcgccgtgcttaccggtcattaaatcataaagatgcaagtaaggtgtcacatctgataacgtcatttgtttggcctttaaattagcgacaaaatcagtcacatgatcattccagatttctggtgtcaggtcaaattcagccaaatcaaccaattgcggcacaacccgcatgaagtggacgtattgtgcttgaatactcaagaagcgattgcgttgaattcctttttgaacgggtttgaaagccttcaaaacgatttgtttagcgatatatttactttccgcttcaccagtcttaaagtccttacccgccataatttcgcggagttcttcatcactcaagttttcagcgcgttctgtcacccagtccgccttggtttcgtggtcgactttatggctcaaactgcgcaataaactttccttcgtcgcatctagccggtttcctaaatgatagttttcgttgaaacggtaatagacgtcgctgattttttccttactaatcaagaccttcccgttcactttcaaatcacggaaacgcatatcgcccttttcaagatgcgctgcgtaacgtttaactgctttatagaagactaggctttctttcaaacggctaatccgcgcatcagtttccgtgattggggtttcaaattggtcaaataaactctgaacagcaaggttcggcaaacgccgtgcaacatattgatagtaagtcatttgaatcatgttttgctcgccaagttcaggcaacacgtcggcgatataatcgttgaacaattggttcggcgagaacatgatcacttgactggaatccaggttaccccgataccggtaaagtaggaaggcaatccgttgtaaaatcgcggatgttttcccagaaccagcggccccttgcacgaacaataagtccgcgtcagtattccggatgatttggttttgttcccgttgaatggtcgtcacgatgctcttcatttgggtatcagacttttcgcccaacacttccagtaacatttggtcaccaattgtttcttgcgtatcaaataatgccttaatttggccatcttcaattaagaattggcgtttcaaagaaatattgacgtcttgcgggccgtcaggcgtttggtacgtaacttcaccagtcttcccttcatagtaaattgatgaaataggtgcccgccaatcataaatcaagaaatgatcttcgcgatcggtgaatgaccctagcccaatataaatggactcagactttggttcacccttttctttaaaatcaatccgcgcgaaataaggggttttttccattttttgtaaagtctcaagttgccgggaagattgttgccaagaattattccgttcttgcaacatttgccgttgttgttcgattgagactgccgtttcagtcattgctgaatcattattgaaattcaaccgtacatcattaaagaagtttgcgttaatttctttttcttctgatttagcccgttcaacggcgccttcgaagtgcttttcggcgtttttaattaaaccgacaatctcggttaaacggcgttgttctaatgatttttgttcgtcagtcaaagcagatgtcccccgatttctaaataaacagttctacaagtttaacactaaattcacaagagtgcgactacaagcgcttagccattgaggattagcctaataccgtgaacgagcgacgtagtcgaccgtttgcggtatgtagcaaagcacagaagtcagtttcaaaaagcacgtttcaatcagagtgtttcagcaaatgtttaactttcgagcattagcctaatcagggaaataagcgatgtagtcgattgttttcctgatgtagctaagcggaaaaagttatttgctagagcacgtttcacgatcttcctacaaaaaagccggccgctgcaaccaccagccctaacccgtaggttaatagcagataaccaaagaaaatatggtaacggcggcgaaaccacagctgactcaattcgctattgaacgttgagaaagtcgtgtagccacccaagaccccaacgcccaaaaagagcgtccacgtttgatccaattgtgccccggtcacccagcctaagcaaaagctccccgttaaattaattaaaaaggtgattaatggatattcgctggcaatctgcgttccaagacgggttaattgataccgcaaaatagcgccgattgccgcgcccaatccgacaattaataacgtcatcattttagcacctgcgactttccttgccgatcgagcagccaaactgcccagtaatctgccactaaacttaagcagacgccgccaatcaaactaatcccgatatacaggctaaatggccaccattgattggccaccaataacttcaatgcatccacgctaaaactagaaaaagtcgtgaaggcgccgaaaaagcccgtgcccattgcaagtgccagcgtatcgctgatctgataacgaaccacgatgtaacgcattaaaaaaggaagacaaaacgccccgattaaattcacacacaaagtgccatacggaaaccccgctgcttggtgcaatccgagcccaattgcatagcgtaaaatcccgccaaaaaaggcaaaaattccaaccgcgagactttcttttatcttcattttagatcgccccctttttaatatcgtagcatctattttacagaagttattaccaattgtaaattagttgtagatattaactagcgataatgccgacttctttataataatttaatcactaaagaattatcaataaaatcgataatattagcgtcaatatataaaaagccaattttacgaacccgtgctgttgctcggaagctattcggctttgacatgctttagtaggttagtgtatgctctacacaactttattgtgcattgaaaggatcttttttatgactagcttagcgctcgtaatcgttctattggcggctttaatgacgccgttactcatggcaaagtttaagatttcttatttaccaaccgcagttgcggaaattttggtcgggattttactcggacaaagtggcttccacctcatctcaaccacccccacactgacggaactttcatcattgggtgtgacagtcttaattttcttaagcgggatggaaatcgactttgaactctttaaaaagcaacctgctacagctaaatctggcgttaaaacaccgctgacgcccttacaactggcggtcggtagtttttacgctgatcctattaagttcgctaggactcgccagtttattggcgtggagtgggttgttcaccgatattggactcgcaacaattctcttttcaaccatcgcgttaggggtcgtcatcgccgcgttgaaagaaaaagaactcctcagccagccgcttggccaaacaattctgttaattgctgtcctcggggaaatcgtcccgctgatttcgttaacaatttatgccgctctcaataaccctggttctaagagtctgtggttactatcactaattttcttagccgcgatcttcttattgatgcgttttaaaactgtttatcacttctttgagcggattgataagtcaacgactcaactcgatattcgtttagcctttttcttaatcatcacacttgtatcgattgccgaagaagtcggtgccgaaagtattttgggcgctttcttagccggcatggtcatgaaacttctacgcccccgtgaagagacgcaagataaattaacatcaatcggctacggctttttcattcccatcttcttcattatgaccggtgcaaaactcaacatccccgcgctcttacgtgatcctaaatcactgaccctgattccatttttcttcatcagtttcatgggcgccaaagttttgatttacttcgtcttaaaacggtgcttcaaagtcaccaacgccctcgccgggactttcctcagttcgacgaccatcacgttggtcttacccattttgacggtcggtctcaacttgaaggttatcacgacacagcaatccggcgctttcacaattgcagcggtgattagctgtattcttggtccgattctgttcaatcgattctacttaccaacacctgaagatatgccgcgcaaacgtgttaatttcatcggcgccaacatcatgacaattccaatcgcccaacagttatccaaaggtctctacacaagcgaattatttaccaataacgaacaaaattatcaaatctaccatagccaagccaacctcgaactcttgcctgacttggcaccagccaccttaactgacgcggccgtcttcgatacagatatcctggtcttaggctatttaaataatgagcaaaattatcaacttgcccaacaagcgattcaggccaaagtaccgcggatcatcgcccgctttgaatttaagaatatctcagacgatcaatacgatgaacttaaagaacacggcgttgaaatttttaacgcttacgaagcaaatatcagtctgttacggagtttaatcgagaccccatctaccttacaaatcattgataacaccgatgccgggctcttcgaagtcacggttaaaaatcggcgcttcaccgggattcaactttctaatctcccatttgtggaccaagtcacaattagtcgaatttaccgcaataagcaactgatcatgccgcatggtgacacgcaaatccatctcaatgatcacctcatcctaacggggaataaacaggctgttcctgccattcgacgccaattagaaacgctcaactaaatcatgttgaccctcgcacattctctctaataggtttataatgaaactatcataattaaaggatggtgcagatatgaaacaaggaacaacaatcctcacattggataatggttaccatttatggactaacacgcaaggaacaggcgacattcatttactctgcttacacggtggccctggtggtaatcacgaatactgggaaaacttcggtaaggaattagctgatcttggtgtacaagtacacatgtacgaccaacttggttcattttattctgatcaacctgattactcacaaccaggcaatgaccaattattaacatatgattacttcttagatgaagttgaagaagtccgtcaaaaactgggcatcgacaacttctacttaatcggccaatcatggggtggcgcattggtccaaatgtacgctgctaaatatggccaacacttaaaaggtgccatcatctcaagtatggtcgatgaaattgacgaatatgtcacaaacatcaacaaaattcgtgaagacatcatgacccctgaacaattgaaattcatgcaagactgtgaagctaagaatgattacgacaatgatgaataccaagcacttgttgacaagttaaacgctggttacgttgatcgcaaacaaccacttgcaatctcacatttaatcccaacaatggcaaccgacgtttatggcgtcttccaaggtgataatgaattcgttgtgactgggaaattaaaggattggcatttccgtgaccaactccacaagattactgtcccaaccttaatcacattcggcgaacacgaaaccatgccaatcgcaactgctaagattatggctgaaaagattccccatgctcgcttagtgacaacgccaaatggtggtcaccatcacatgattgataacgcacccgtttacttcgatcacttgaagactttcatcaaagacgtagaaagtggcaactttaacgattaaataaaaaaaagccgcgcacaaatttaaatttgtgcgcggctttttttgacctaatcgataatatctgaattaggttcccatttatccattgtatcgaataagtggcttgtttgtgcgaataattgagaaaggtctgcattgccgtcatctttaaaatgtttaaagaataagtagaaatcaacttccaattgatcaacccttcgtaatccttgctcattcaatgaaataaatactttacgttggtccatttcatcactgcgatttttaacaattaagtgttttctgaataaaacattaattttacgtgaaattgctgggcctgaaagatcaaaggattccgataatttcgccacttcaatattggggtttaatttgacctctctgagaatcaaaaattgatcatatgtcaagtcgtgcgtgacagttaaatgatttatcttattgtaaatttggccaatttgcagataccattcgttgaatcgatcaacaaggttactatccgtttctggttgcatcgaaccactcctttacataaacactaaatgtggttattaagtgttactagtcaaaagtaacacaaaatgtataaaattaaaagatttatgcttagaatactaataaatattgataaagttatttattagtatcttttaaaatttattctctcttaatgataattgcaattgatgataaatcaattattattattaccattaaaaattataaatatatgtaaccgttttgcaaaaaatatggaatgaccctgcacatcatttttatctatgctagaatgaaggtactaaaagctattgttggagggttacgatatgaaacgaatcacactttatttagtgcgtcacggtcaaacattctttaaccgttataaccggatgcaaggttggtcagactcaccacttactccgaaagggattgcagatgccgaacgcgctggtaaagaattagcgaaagttaattttgctcaagcttattctagtgaccgcagtcgcgcaatggacaccgctaaaattatcctccataagaatttctaccttgatactccatatgctatcacaccgcacttccgcgaagaattctacggctattttgaaggtgaagattcacccaaagcgtggtacatggcaggtgccagtcatgatgccaagaccttccaagaaatcatcaccaaatactcactcgatgcctctaaagatttcatgaaagaagctgatcccttccacgatgctgaagatgccgctgaatattgggcccgcgtcggtaaaggtttcaaacaacttcgtgctgaatgttctgacggtgataaagtcttgatggtcagtcatggcacaaccattcgcagtattgttggcaagtttggtaacgaccaattcgatgttaccgttagtccaatgaacggtagtattactaaagttattttaacagacgaaggcgttattgttgaaagttacaatcaattaacccttcaatagtatcaaaatgataattgatgtatgaatattcattgaatatagagctgggcaatattattctgattgttcagctttttttgcgggcaataattcatgtcgttcaataataatacgcgcttcaaatgacagttttggcagtcttctttgacatttttgtaggtaaaatacttaccacaattgtagctaaacaagttaaaaactaatccagcgtggtatacgcctcttaatgacatcagtgtaacaagtagcgtctagagaaacaacttcgacctcatctaaaaaagccccctttaatctcgaatttcagattaaaggggctttctcagactgattcctatgttttaaactgtttcaaccatctactatttaacttccttcaacacaattcctttgtagagccatgtagtgagcaagtagtagattgcgtagagaataatgaaaattgaaaatggaatccagagatcattatatggatcaatcataatcaatttgaacaattgaagaccaaagaggacatggatgacgccgacgatacctggtaagaggaataagaccccaatttctttggcaatggattgttgcaatagattgcgacgcgtcccgattttagccaacattgtgtagcgtttaacatcactagctgctccagataaaatcttgaacatcaagcaacttgctaacatcgctaagaatgcaatcccgaggaagaagcccataaattcgagcccactgaacatgctgttcgctagcttatagttagcatacttgctactatccattgtagccccttgacctttagccaattcaggatttgcaatcacttgttgtgcgtgaatttttttgataacgggtaaattaaccgcaaagtctttgacccgatatgttttaacttgcgtggttgcgcctgccacttgattaaattcagcgtcagagacgactttaacgtccttactagattgacttggcacttgaattgcgcgcaaggatgaagaatcgccgttttgaatctcactgagtttcaccggtttaaccccttttgcgcgggcgacaccattcccattaccaaactgaatggccatgattggtgacttttcaagttgtgctgtccgatagtagacagttttcgcatcttctttaacatcgtaattagcagtcgccttcacaccctttaaatcttttgtgaggcgcaatgcttcttggttcggttgatttaaaacaacgtcgtaaggcgccattgtttctgccatttctggaatttcactttgatagccaatcccaactgtgattgcgcctagtgccaatgcaaataacatcgccaccaatgcgagcatcttggtgtaatccttaatacggaagctcaattgcgctaacgtaaaattatttaaaccacgattacgaatcttgctgttacgtttgagcaacgtaatcaaccagccgaaaagggcattaaacaagaagtacgtcccgagcacaattgtcactaatgccacaactaagcccataatttggaacgttgcgactttaatcatcatatagtaaccaacagctaagaaaagtaagcccaagacaatttgcacaatacggcttaatttattttgtgaaacgcgatttggttgttgatcatcgtgtaagagttgtaaaactggtgttttcaaaagttggaattgattaactaccgctgcaataatgaacaagataatgaagaaaatcaaagttactaacactgcaggtaagtaaaacggtgagaaatgcttaatctgaatatccatttgagacaataacagactgctaacaatttgggttaatccgaccccgagcgccgttccaatgagagtagcagctgtcccaatcactaatgtttcagcagcaattagttgggcaattttgcggccttttgcgccgagcatcatgaacatcccgtaatcacggcgccgcatgctcattaagaaattattcgcataaataatgtagactaatgtgataatccctaataaaacagacccgatttggaaaataatgcccgccatactaattggcgagttactcgtaacgaaacttttgttagttgccagtgcttcgaacatgtaaaaaatggcgcttgccataattagaccggaaaaaagcactaaatagtctttcaaacggcctttaatgccggttaatgataacttcaataacatatttagacttcctcctaatggttaaatgtgcctaatgtatctaaaatttcttgataaaaggcttcccgactcttatcgccgtgaacgagttcttggccgatttgaccatctttaataaacaagattcgttgacaataactagctgaaaatggatcatgcgttaccaataagattgaaacgcgctgttcttcgttcagttgagccattgtatccagtaattccttggcactctttgaatcaagtgcacccgttggttcgtctccgaataaaatagctggattgtggactaaagcccgcgcagcggcgacccgttgtttttgaccacctgataattcggttggatatttgtttaataaactatcgattgataacgtcttggcgattgatgtgactaaatcgcggacttttttaccgccaacattttgtaacgtcaatggtaatgccatattttcataggccgttaagttttctaataagttgaagtcttggaacatgaacccaatttccttggcacgaaaatcagctaattcattccctttcaacccattaattgcttgcccgttaatttcaacttggccagcagttggtttgtcaagggttgataaaatgttcaataaggtggttttccctgaaccagaagcccccatgatcccgacaaatttgccctgtttcacatcaaaagtaacgccttttaaggctgtgtattgcttttcgtttggtttaccgtatgtttttttaacgtctttgacgctaacgactgttggtgtgtccattaataatgcctccaaattttatgataattctatcttataagatattaaaacggcatgcgcgctttttagatgacattttaacgggctaaaataacaattttgtaagattattcccccgttctttaaaaatcaatgtgaaacagtcaaaaaagttttgtcttccctttctgatttgactataataaaaacattgtgaattttcaaaaaaggggtttctttacgatggatgaaatagaaccaaaaaagaaatatattacctggcaagtccttgctttaatggattttgtgaccgtcattggatttgacgatattatttataactttcaaaaccaagggatggcagttgtcttctcatggattgtcttactattcgcctatgtcctcccttatgaattaatggttggtcacttaggctctgctttcagtaaagacggtggcggtctttccagttggatgcgccatacaagcggtgatgtttggggttacttaaccgcttggtgttactgggtagcgagtttgccatacttggtcgatgttgctaattcaatggtcgtttccttcttttggattattactgggaacggaaatcttgaagacaagctctcacgggcttcctttgcgcttttaacagccgcaattaccatcctcttcatcttcttccaacacaagtttacatcgtctctacaggtactcagtatcgttggtgggggcgcgatgtttgtcatgaccatcctctttgtcctaatgacctttgttggtttattgaacggtggtcacattgccacccatccattaaacgcacacaccttcattccaaaatttgatttacattacttctcaaccatcggcctcttaattttcgccatgaacggtgccgaacttgttgcaccatacgttggccaaatgaaagatggtaaaaaagattttccaaaagccatgatggccctcgctctaatgaccgccttcctaaccatcttcggctcattagcaatcggcgtcttcttcgatgccaaccacttaccagctgacttgaagatgaacggttcatactacgccttcttagcccttgggcaacaattccacatgggtaaagtcttactctacatcttcgctgttacccaagcgatttacatgggcgctcaattagcgatgctactcgatggcggcacacggattttcttatccgacactgccaaacaattcttaccaaaagcactgactaagaccaataaacaaggccttccaatcaacggttactggttgaccactgggatttgtgcctttgttttagcatctagtgcctttctgcccgagattaacgacatcttcaattggttgttaaatattaacggtatcgtctcaccatttgtaacttgtttcatctttgtcgccttcttacgggtccgtttcaatagtgaaaaattcccatcagaatacacatacattaaaaacaaaccatgggccatcatcgttggcttctggtgtttagccattacagcattaggaacgatcttcagtatcttcccacaagatgccacacctggcacagccaaatatacacacgaattaatcttaaacatcgtcgtctcagtcgccttaatgggcctcggcgtgattttaccactggttgcaaaattccaaagaaaacgagcagcctaactaaaaaagattcgcccatatggagcgaatctttttttattgcctgggaaatgttaataaatcataaagccatctggttcaatgatggtcgctgctgtttgctgctgaaccccttcagacagaattggtgtcctcattgatgcaacactaacggctgtttgacctgcattaaaaacagccgtcaattgttgctcacctaatcgccgagtcatttttaagacgtcgggatgagtcggctcaattaaccactcaagctgtccttccgacaatagtttttgcttaccatggcgaagcccaattagctgcttaacgaactgatacatggcttgatcttggtccacgggatcccacaccatgcatttacgattagcaggatcgtccactcccgtcatgccgtactcatctccataatagaggcatggcacacccggctgtagatacataaaagccatcgtttgacgcatcaagcgtcgattgtcgttggccatcgttagcaaccgcggcgtatcgtgcgaatctaggatattaaactgcacctgattaatttgatcccggtacagcattaactgtcgattcagcttcgaaaccatttggtggagcggaatttttttatgaataaaataatccaaaatcgcatcagtgtaggcgtaattcatgactgcactaaactcgtcaccgctgagccaactctgcgctgaatgccaaatttcaccaagaatatagaaatcaggtttagcagcatcacacacctgtcggaactttttccaaaagtgatgatcaacttcattggcgacatctaaccgccaagcatcaatatcaaatgcttcaatccaataccgcgctatcgataacaaataagcttgcacctctggattagccgtatttaattttggcatgtgtggcgtcgtggcaaagacatcatatgtaatgtctgtagcatcttcgaaattccgacctggctgataacgcactggaaaatcccgaatatggaaccaatcagcataccttgaagccgcgccattttgaatcacatcttgccattgtggtgattgatcgccgagatggttgaagacagcatctagcatgaccttaatccctctttgatgacaagcagtaatcagctgccgtagcgtctcgtcattgccaaaatgtggatcaaccatccgataatcacgcgtatcatatttatgatttgaaggcgccatgaaaattggattgagatacaatccattaatccctaacgccaccaaatgatctaaatggtcaataaccccttgtaaatcaccgccatagaaatcttgagcctgtggtgcctcatttgtccacggtaatgttccatctggatcatttgtcggatcaccatttgcaaatcgttcaggaaaaacctgataccaaaccgtttgtttgacccactctggtaccttagcccgatcaatttcttggaaatagggcatccgaaaacaagcatctgttttaggtaagattggaccaggcccctgatcaccataaaaagtgctggtcccgtccacaccaatcacttgaaaagcataggctaatcggcggcgatcaatggtcagttcaatcgtccaaaaacaagcgagatccgttattaagccttgctgcatccgaatcgttttcggttgccaactgccatcgactaatatataaggatccccatacactaggtacactgcttcaacgtcattacttgccgtctgcaatcgtacccgtagcctatctggctgatataagaaagcaaactcactatctggtcgatgataaatcgctgctaaatccatttgtctcctccttaaaaaaaaccagtccaacacacacccgaaggctcggttgcactgattaattagtgttgatactgttcaaaggcttgttctaacaaatcagccgttaacgccgccgttgtagggacaacaaccgccgctgctgataattcgctcgcatgaccaatcgcaaccgaaacagcgcctgcagcattaatggcggccacaccagctactgaatcttctaatccaacgcattttcgcggattaacagcaatcttctgagcagctgcgatgaagatatccggggctggtttaccttggtgcacgtcattcggattaacaatcgctgtaaaatatgctgataaagctaatcgatcaagaatgagtggcgcatttttgctagcagaagcaatgaccattggcaccccgcgcgcttttaatgctactaacaacggttgaatacccggtaaaatatcggcagccgttaattgcttgatagcagccacgtaattttcatttttttgagtcgccagtgctgcgagttgtgccaccgtatactggccatcaagttgggcaaaggccacaattcgttgaaaggatgcttcccgactaatcccttttaactcagcttcaaagctatctggtaagctgacgccaaacgcttgttgcgccaattgacgccacgccgcaaaatgaaatcgggctgtatccgtaataaccccatctaaatcgaataagacaccgtccataataacctcctattccaacatcatcgacgcatcattgacttgaattgccaaacgatcgcccttgagtagtttgatatcagttcggtcggccgtcacgctaattttcaacagccggccgcggaagttaatatggaattcataagccgtccattttttgggtagaaatggtttgaatgataattgtccttcatcgctaattcgcatgcctgcaaaaccttgcacaatcgctaaccaactccccgtcatcgacgtaatgtgcaatccgtcatcggtatcattattgtaattatcgagatccaggcgtgccgtccgcgcgtacatttccaccgctttatcttcgtaatgcagatcagccgctagaatcgcatggaccgccgctgataaacttgattcatgaaccgtcaacgtttcatagaaatcaaaattacgcttcttttcagcagctgaaaaacgatccataaaataccaaatgccttgtagaacatcggcttgtttaatgtacggcgaacgcaaaatcttatcccatgaccaatgttggttgatgggccgttgatctgctgggattgcactgacaggctggatatctttatctaaaaagccatcttgttgaagaaagatcccgagttgttcatcttgtggcaggtacattttttcaataatcgcttgccattgtgagagttctgcatctgaaagtctcagatccgcttttttggtatcgcttacttttttgagcgtttcaatcgtataactaagcgtccattgcgccaataaattcgtataccagttattgttaatattgttttcatattcattaggccctgtcacaccgtggatcatataccgctgcgcacgttgtgagaaatggacacggtctgcccaaaagcgtgcaatctcagttaacacttcgataccttcattgagcaaataagtctcatcgccggtgtaacgtgtgtagttataaattgcataggcgattgtgccattgcgatggatttcttcaaatgtaatttcccattcattatggttctcaatcccattaaaggtcaccattggatagagcgcgccttttaacccctgttgccgggcattgtgttctgcacccgacaattgattatgccgatacttcaatagattcaacgacactttcggatcagccaatgagagataaagcggcattgcaaaaccttccgtgtcccagtaagttgcaccaccgtatttttcgccagtgaatcctttaggaccgatatttagacgctcatcttcaccataaaaggttgaaaaaagttgaaataaattaaagcgaatcccctgttgggcactatcatcaccgacaatcaccacgtccgccatctgccaccgtttcgcccattgattcgtctgtgccgctaataattgctggtaactttgttgcgcaacgacctgcttgatacgttgcatatttggtaccaagtccaactctgaataatctcgagaagtcaccactaccgctcgtttttcaaaattcaattgcgttttaggggccaattgctgtttaaaacgttgcccaacttggtgggcttcttgaagcccagtatctgccatcattgtcgtttgatgatcaatttgaacccccacactaaaccgtggtaccccgaaatcgttgggcattgtttttccgaccaaataagtgtcatccgcagcgtctgactgctcaatcacttgccagaattgctcaccgtaattcgcatcctcattttgaacatcagcatcgatcatagaactaatctcaatctcaactgcttcgctcgccaagttttcaacagtgtagcgcaatgcgcataattccttttgaacgatactaacaaaccgctctatcgtaacttgcacttgtttattatttttagtaacgatgaattggcgggttaacaccccattatgcatgtcgagtgccaatttaaatgcggtcacttcatctttgcctaaatccaccgcttgaccatcaattttaagattcgttttgatgaaattgatggcattgatcactttcccaaaatagtcaggataaccatttttccaccagccaacgacggttttatccggataccagacaccaccgagataaatgccaggcaggctgtctcctgaataatcctcttcgaatacgccgcgcatccccatgtaaccattaccgatactcgtcatactctcttgtagccgtttatgtttacgatctagttgatgcgtgacaatctgccacggatcgacttcaaaaattctctccatttcgttccctccgatacgtcagccaaaattattccgcctatttagcagcgcttaatagattgtttcttccgttgcgatgtcgaagtagtgcgctttagacatttcaagcgccatctcaacccgatcaccaggttcatgataatcccgcgaattaacttcagcgataaaatcgatttgtccaatctttgaatagagcattgtgttagcccctaataactcggaaacgacaacctctgccgttattttagcatctgggaatgtttggagggcaatttcttcagcgtgaatatcttccggccgaatccccaagatcacttgttgaccatcgtagccaccggcaatgagctgtttcaactgaccttctggcactgcgatatttagaccatcgtcatttactagatgcccattagttaaggttaccgtgaagaaattcgttgctggtgaaccgataaagcctgccacaaacttattaaccggatgattatagagttcagttggcttgccgacttgctggattttaccatcgttcatgatgacaatccgatcagccatcgtcatcgcttcaacttgatcatgcgtcacatagatgaaattacgacctaagcgttgatgtaattgcgcaatttcagtccgcatttgcacccgtaacttggcatccaagttcgataatggttcatccaataagaacaacttagcatcacgaacaattgctcgtcctaaagctactcgttgccgttgcccaccagaaagagaagatggcttccgatctaaatactccgataaacctaagatttctgctgcggcatcaacccgttttttggtatcttgcttatcattcttacgaatattaaggccaaacgccatgttatcgaagactgtcatatggggatagagcgcatagttttggaaaaccatcgagatatctcgatccttaggcgcaaccttgttcatcactcggtcgcccattttaaattccccatcagagatatcttctaaacctgcaatcattcgtaaagttgtcgatttaccacagcctgatggcccaacaaatacgatgaattcaccgtctgcaattttcaaattgaaatctgtgacagaattggtatcatttcctgaatatttcttattgatatgatttaaattaatttcgaccatcgatcatttctcccttacttcgtttttaactggtgcaccgttcaataattgatagctaatgaaggctgccaacgaaacgctcgcaacaagaatcataaacgcgagttttaaaaagacattaatgcccatcaacaagatgaaaacgccggtggccagcactaatttgcccccattggcaatgataaagccgcctaaggtaacatcatggcgcgctaacccgaccaagtagcttctggcaacgacaactagcaataacgccccaaaccagaccaataagccgctacgaactaaaacatcgcctacactggcttttagtaacaacacgatgatcatcaatgccgtcgctaacgtcagatttactaaaaagtctggcagtgcctgccgccacccttttaacacaacgcgtgcataattaccatcaccgttgacttgccattggtccaccgctctaaaaaccgcgactaaacttggtagtgtaaacaaactgagcattaacactaacacaactgcaccgggaatcattactcggccgtttggcatactaaacgttaaaatcagtgtcagaatgacagggaaattaatcccaaaccaagcaaggttgatggtaaaaagcgaccataaccaactcccggctgccaataacgtttgtcttgtttcgctgtgctttttcacgatcaacacttccttaattatttaacggcgccatctgtaacacctttgataatccatttttgagcgaataagtagaagacaatgaccggaataatcgacaaggtaatgccggctaatgcgaggtgccattgtttcgtgtattctccgaagaaattaaacatttgtagtggaatcgtatattgcacttgtggtaagaccaatgatggtaaaagataatcgttccagatcgcaatgatgttcaaaatagcgaccgtcacagtcattggactcaacattggtaagatgatcttgtaataaatttgccaccgactggcaccttccatttcagccgcctcatccattgcaattggaatacttgaaagggtgccttgatataggaaaatcgataaactacagttgaagcctaaatacatgaacatcaagccgtacatattcaacagatgcacattaccgaagtttgccgtcaacggaatcataactgattggaatggaatcaacatcgctgagatgaaaagcagcaataaactgctactcaacttcgatttattccgttgcagtgcataggctgccattgaagaacagaggataatcagcaacacactgcagactgtaataatgagcgaattggtcaatgaactaatgaaattcaatgctttaaacgaatctccatagttcacattcgtgaatggattaggcagcgacaatactgaggcaaaaatgccttttggtgttttaaatgagttcgttagaatcatatagaatgggaataaccataaaagaccaatcaatacaccgaggacgccgatccaactatttcttttcttattcattagaaatcgccctcccgtttacggttataaaagacttgtactaaagaaatcgcagcgacaatcaagaagaagaccattgctttagcttcagcgagtgcgaaatcactcgaattataggctgtattcacaatatccatcgccaacatttgggtcgagttgtaaggtcccccgttggtcaacgacaagttttgatcgtagattttaaacccattcgacagggttaaaaacatacagacggtaaatgctggcgcgatcattgggaatgtaatccgcgtaaatcgttgccaagcagatgcaccatcaatttcagcagcttcaatcacttcacttggaatattttgcaagtaagcaatatagataatcatgatgtaaccactcatttgccaaaccgtcacaattaccaagccccaaaaaccggttagtgaattcgttaaccagttttggaagacagtcatgtgtaaggcagatcccaaagcgctaaagccttgcgtgaaaatgaattgccagataaatcctaagattaacccaccaatcatgtttggcataaagaagatcgctcgtaaaaaattgttgcctttaaatttctgtgtcacaagtaatgctaaccccaagccaattacatttagcaagatgacggtcacgataacaaaagctaccgtgaaccaaaaggcgtttccgaatgctttatcttgtaataaggccatgtagtttttaaacccaacgaccttagtaaaagagagtccatcccagtcagtgaatgaatagaataggccctccagcattggaatgaaaacgactaatgctaatgcaacaagggtaggggttaaaaataaccaaaatgataaactcttatttttcatttcaataccctctttttgttttatccaattgaataaatttatttagtttgttgttttgtccaaccgtccttcatatttgaaacagtcttttgccaatcttggtcacctgatagatatttttgtaggttaggttgggcaacgtctggatcccatgatgtgccagtataacccgggaaaacccagccgaatgttgctttcttttgactgtaatcatagaccgattgtgtgagtgcatctggcatcttcacatcaccgtaacctttataagcaggtacgaaatgtaatttctcaacaacgtcttttttaccttctttagacgtatatagccagttcaagaagtccttagctgctttttgttcgtcggtactcttccgtttattaactgcccagtagattgaggtcccaacaggcatcttaccttgttgttccttaactggcattggaatcatgccgatcccgtcttgagcgaatttcgcatcaatttggttaacggtttcgtaaatccagtcgccttgttgaatcatcgcaacttttccttgagcaaagttttggttcacttgtcccgcgtaatccatttgcatgactggttgaacggaatattctttttgcaaatcaatcatttgtttcatttctgcgttgttttcaaaccgaaatgaaaggaatcatttaatcatggaaaaacaaacaattacaatttatgacgttgcgcgcgaagccgacgtttcaatggcaactgtctcacgagttgtcaatggtaacccgaatgtgaaacccgcaacacgtaagaaggttcttgaagttattaaccgtcttgactaccgtccaaatgcggtggcccgtggattagcaagcaagaagacaacaacggttggggtcatcattcccgacgttagtgacatctattttgcatcacttgctcgtgggattgacgatgttgcgacaatgtacaagtacaacattattttggctaactcagatgaaaacaaccaaaaggaagttcaagtgttgaataccttattggcaaaacaagttgacggtttaatctacatgggccacagtatttcagacgaaatccgcgctgaattctcacgttcaaagacaccaatcgtgttagctggttcaattgatccagacgaacaagtgggtagtgttaacatcgattacgttgccgctgttaaagatgcaactttgaagttaatcaaaaatggtcatgacaaagtggcgttcgtttgtggtagcttgaaattcccaattaacagcaagtatcgtttatgcggttacaaggatgccttgaatgaagcaggcattgcttatgacgaaagtttaatttttgaaacagaatacagctacagtgctggtgaagcattgttcagcaaaatcaaagcaactggggcaacagctgctgttgtcagtgatgacgaattggcagttggtgtcttgaacagggcagttgatgccggcgttcaaatcccagctgaattcgaagttgtgacaagtaacaacacgaagttaactgaaatggtacgtcctaagatgacgtcaatctcacaaccattgtatgatatgggtgccgtagcaatgcgacttttaacaaagatgatgaacaaagaagacgtaaacgacaagacaatcctattgccatacagtatcgtagcaagagaatcaacaaaatagagtgctattggttgcggtcagcaattgagcattaataaaaaaatcccgttaatccaggttttaggattaacgggatttttagattaagcggaagttgttgcaaacaagagcacgtttccaccaatcaaaaaaggcctcagttccaaacgattttaaatcgttagaactgaggcctttttttagtttagttcgttgtctctgtatctgttggattggtattcgctgtataattcgtaccggttgtagtgccagtcgtagcagcagtaccagtcgtagcagcagtaccagttgtgtttgctgtgtaattatttgtcgttgttgctgcggtgccactgcgacgactactgtagccactagttggatttaattcatcagcggtgctataggtaattgaaccatagccgttgttataacctaaatagtggttccagaaagtttcgtagttccgggcagaaccgccaatcccgaattcatagctagttgcttttggcgtccagttgttataaagcgaggtgacggttgaaccgttcaagttctgtgagctgccgttgattgaaaccgtgccaggtaattgaccagttaatttcaagactttgctgcttgtgaccgtacttggcttttcatgatcatcttccaaacgcatgaggcttgggttgatctgataaacgctgttggccaattttgaccagtatctttcattaatctggcttgagttgtcagttaagttacgaccagtactgtcataacccatccatgaagcgagggtgatcccaggggtactcccgataaaccagatatcgcggttatcatttgaagtcccggttttcccaactaagttgttggtattaaagtagagttgatcgtaaattgaagtagcagtcccatctgttaaaacgccggctaacatttggttcatgatgtacgacgttgcttttgaaaagacgcgtttcttcttagcgtgatgttggtaaacggcattaccggcgggatccgtaatcttttcaatcacgtaggcgtcggtatgttcaccttgatccgcgaaggttgaaaatgcactggcctgttctaagacgctgaccccatcactggtcccaccaagtgaaatccccagttgactgtattcatcagcggtgaggttgatgcccatcttactcatgtacttagaaggatctgttgtgttcttcaaagcgttataaaggttaacggttggaatattcaatgactgggctaacgcttcgtcagctggaatgaatttgttctggatcgtgccaccgtaatcggttggtgcgtaatccttgaagttggtcttgaaatcggccaacatcgttttagaaccaatcagtttctgatcgattgccggaccatagactaacaatggcttgatagttgaaccaggagaacgtttggtcaacatgtagtttgtttgtttgagtgagaaatcacgtccgccgacaaaagaaatcactttcccagtgcggttatctaacaagacgctcccgttttgaacaggggacgaaacggtcttttgtaaccccgtttcttcgtcagtaacggtatcggtataagtccgtccgaatgttgcgccctgttggtgaacaaccccttgcatggcatcgtaaatttcttgatcgatagtactgtgaatttgatagcctttagtgctgagtaattcagttgcttgtgtttcatattgtttgtagagatttggatctttgttgagtttggcagttgaaacattggcttctttggctaactgtttggccataatatcagttgcttgtgtttcaagtaagttataaacatagccataactcttcgttgtttcggctggatcggcttttggttggaattctttggttaagtcgactttcttagcggctttgtattcagcctttgtaatgcgatcgtcacgatacatccggaataacacggtatttttacgatctagaccatattttaagtattcaggatttttaagggtgccgtcttgatcatatggtgtatagacggaaggactctgtggcagaccagcaatgtaggcagcctcggctagagaaagatccttagcatttttgccgaataggcccaatgctgcttcttgaacaccagcgatattttgtcctttattgttacggccaagagtggcaacgtttaagtagtcttgtaagatttcttttttagtgaaatacttatcgacccgcaaggcgagcaagacttcggttgctttccgtttaaaggttacttgggaggttaaaacctgcatcttaatcaattgttgcgttaaagtcgagccaccggtttgtgaaccaaacccagtgacatcggaaataacggcccgcaagagtgctttggggacaaccccatcgtgtttatagaaatcctcatcttcggttgcaacaatcgcatcctttagataaggggacatctcatggatgttgatgggagtccgaattaagtcggttttgattgcgccgaacttattgttcttggcaaagtataaaccggctgcttgatcggtattatcaagttgttgctttagcacttgataactcggaattggttcggatttcattaacgcagcaaaatagcccgcgccaattccagcagcgagcgccatacagattaagccaattgagatcccatagagaaagatactcttaatggcttcaaagaagacgttaatcttaaaagagagtggtgattggctcaactcttggatgtaggctcttttttgttccttagttggttgtgcagaacgtttatcgggtaaatggagcaaatgtgcgagtctgtctttagcagatgtcaatagcgttgagaccttttgtctgctcgactggagcagtgctcgccatcgactggaacggtgctttggatcattcaaataataacgccaccttttttctcatactgtcccatattatataatagttcagcgcattatcatacccgatttcggatttgtaagacaaatgaaaaatatccagaaatgcacggcaatcaatgaatatagtgcaatttgttaaccaatttgaatcagcagacacaaaaaggggggcgtttgctagcgattaaaagtaagcttttaacgaaatgccgtgaaaacgctaaacgttaggtataccaattatttagcgcgttttttagcgtcaaaaggcttgcaattgaaattttagccgtttataattggactataccaatgaacgacttgaatttttaaaggatgaggagataatcatgatgaaaattattaaagtgaaagatcaagtagaaggcggccaaaaaagctttgaaatcttcaaagaaggtttagcaaacaacgctaaagtattcggtttggcaactggtagttcaccaattaaattctacgaaacattagtggctagcgacttagatttcacaggttgcacatccgtgaacttggacgaatatgttggcttatcagctgatgacgaccaaagttaccactatttcatgaagaagaacttattcgacaagaaaccatttactaaatcatacttaccaaacggcttagcaagcgacatttctgctgaattaaaacgctatgaccaagtgattgctgataacccagttgatatccaaatcttagggatcggccaaaacggtcacatcggcttcaatgaacccggtgctgcgtttgacagcaatacacaagaagtgcaattaacagaatcaacaattaaagctaacgcacgtttcttcgaaaatgaagcagatgtaccaacaaaagcaatctcaatggggattggctcaatcttaaaagctaagaaaatcgtcttgttcgcatatggcaaatcaaaagctgaagccatcaaaggcacagtagaaggcccacaaacaacagacgtcccagcaagtgcattacaactacacgacgacgtgacaatcatcgtagacgaagcagcagcaagcttgttaagcaaatagagtgcgacagcaggcggttatgctctgaggattagtggcatatcgtgaatgagcggcaaagccgatcgttttcgatatgtaactaaccggaagagtatgcctgatggagcccgtttcaaaataagagtgcgtttgaaacgggtatcttctgagcattaactggatttgacgaattgacgatgaaatcgtcgatttgccaaatttggttaagcgcaggaagatgtttcaaaaagcacgtttcaaaacagagtgcgtagccagccgggtatatcccgaggattaacacaggatggcgaatgattgcgtcagcaatcgtttgacattcagggttaaccgcaaggatatggatgacggagcacatttccaccacaaaaaaatcccccacctcaaatcacgatgtgggggattttttgattgcattatttcaatgttgccatcactttagccattgcggcttgttgataggcgattgctgcttttttagcaaccgcttgttgttgatcagcagtcattgctggattggcttgcatagcagccatcacagcttgtttaccggcattttctgcgccagttttaagttgtgcttgttgaccttttaatgttttagcgagttgtttagcttgaacatcacttagaacgaaccagcctttagcaaccttaaatgtgttgtgacgacttacgaattcgtggtcgttaccagaaattccgaaccagaatttagccgtattattttgatgaacgcggtatttggtggttgtcactaagactgctttatcagcatttttttgaacactgttggttgtcttttcagtttgggttgctttgggtttactttggttggcatcggtccgataaagatagactttttcagtgccgttaccaagcgggtgatagagaagcattgacatgcccttcgcatctgcgcttgaaacgagcgtgtgcgtcttagtttcggtcacagttttcattccgtaatgattgtgatcattttggacgatgaaaacgagtgaagcgataaatgtgagtccaaagatggtcattaagattggtcgccacatcttttgaccgaaaatcgatgaaaagaataatgcgagtgtgctgataacgagtgtaatgacgatcatgccttggcacccccattaatcgtagatttctttgaagagaggaagaatgtgatgatgaagccaatcacacagaaaatcacagcaacgatgaaggctgcgtgataaccagaaagggtggcatcaatcatcttatcgcggaaggccaatggtaatgtcttgaccatgtgtgtgcttggcatattgccttttgtaacactagaaagcacactgattaagatggctgtcccgattgagctggcaacttggcggaaagtattattaacagctgtcccatgactaattaagttcattggtaaagcgttcattccggaagttgtgacaggcatcatcaccattgaaatcccaaacatccggacagcgtataacacaacgatgtagatgattggggtagtagctgttaggaagatgaatggcgcagttgcagccatcaataagaacatcccggtcattgctaagcgtttggcaccatatttatcaaaaatacggcccgtaattggcatcataatccccatcatgagggaaccagctaataacgttaagcctgaatggaaggcagattcgccacgaatgttttgaatgtatagtggcaagaccatttcggcaccgaccatcgccatgttcgtcacaccacttaaaatagcggcaattgtgaagacaggtgatttgaaaacgcggagttccaagaatgggttttccatcgtgagttggcgccagatgaataaagcaattaccacaacgccaattgctaaggttgtgagaacgagcgcatcgccccagcctttatcgccaacttctgagaagccataaagcaagctcccgaagccgacagttgataaaataattgaagggacatcaattttaggttttgaaagttgaataacactcttcatttggaaactagcgaggactaagacgagaatcacgattggaataatcatgccgaataaaacacgccagttgtatgaatcgataatccagcctgaaagggtaggccctaaagcaggtgccaggccgataacaatcccggccatccccatggctgttccccgtttttcaggtgggaagatggtgagcataatggtttgcaaaatgggcattgaaatcccaacaccagcagcttgaacaagccggccgattaatagagttgcaaatgagctcgttggtgcgatgtaacagataatagtcccgattaagaagacagtcattgctgacatgtagaggacttttgaattgaatcggttaattaaccaagcactaatggggatcataatcccgttgactagtaagaaaccggttgtgagccattgaacggctgaggtggacacatcgaatgctttcattaatgtggggaaagcagttgataaaatcgtctggttcaagacggtacagaaagtaccaatcaataagaccaagactaagactgtccgattatatggtttcccatgaatatctaatggtctagcgtctgacaagataaaaatctcctttgtgtgtttttgttgatgcgatttattagtttagacgcatttggtatctttgtcaagtaagttgacaaaggtgttatttaacttgacaatcccaatagattatctataatgaaaaataataataggaatggagtggggacttgcaaaaagacctttttttaaagttaatagatacggatcgattgatttttgggattagtgaagtttgtaaagtggcgggggttacaccgcgtcaactccgctactgggagcaaaaaggatacattaaagcgcgtgaattggatggcaataaggcccgcgagtacgacgcgcaaacaatgattaaggcgatctttatcaagcatttcttagatgaaggctacacgctaggggttgctgtacagaaaattcaaaaacacatggataacatgaaggttgttcgttcgataattcgggaacattttgaggggattgaagagattgatggcgaaatggctgttaatctcggttacttcgatgaaacaaagcaacaaatcttatacgcaattgtcaaaggtgggcattcaacgtttaagctgatgcctgctgataaatgaaggcaatcaaaaaaacggtccaaagcgattaagctttggaccgtttttttgattgctaaatgtgttctatcagccatatccttccggttaaccctgagccgcaaacgattgctacgcaatcattcacaactttgtattaatcctcggtggatacccgacttacgtcacactctaccttgttaatctgtaaattgcatctgcatagattgcaatggcattcatgatatcttcaatgtgcatatattcatttgcttgatgcatcacattttcgcgttcttctggtaaggcaccgaaagcaacaccacgttctaagatacgaccatatgtgccgccaccgataacttgttcgtgacctttaagaccagtttgttcttcgaagacgcttaataatgttgcaaccaatggatcgtcaccaggcacgtaatgtggttcttgtgcatgaccgtcaattgttacgtcagcaagatcactaagtgtgtttgctaaaccgtcgcgtgtgctttcagcagtcacacctttaggataacggacgttcaagagcactgttgctacaccatcttgtgtgtagttgaagactgcaggacatgctgttaagtcgcccatcacatcatctgtgtggttgatgtttaagaggtgcccacgtgaatcttcgtgcattaagcgggcaattgttccgatgtagttgccacctttagtatctaaggcaaagtcagctaagaaagttgccaagtgtgttgcagcatttacgccggcttttggttcttgagcatgtgaacctttaccgattaagtcgatgattgtttggtcaccgtcagttgtgattgtcccttgtaacttgtggtcggcaacataggcgtcaaacttagcttggaaatcagctggcattgcacccgttaagatggctttagctgtttgtggcaccatgttggcgcgtaaaccagatttgaagctaaccaatgtcatatcgccatcagcaccgtcaactggtttgaaagtcatgaggtatgacacaatccctttttcaccattgatgattgggaagtttgcatctggcgaaattgcaaagtcaggttttggttcaacttcgaggtaacggttgatcccaacccattcactttcttcgtcagtcccaacgataaagtgcacttttttgtttaattcgataccgttgtcttttaataatttcaaagcataatatgctgcgattgaaggccccttatcatctgatgaaccgcgggcataaatcttaccgtctttgatcactggttcaaatgggtttgtttcccaaccgtcaccggcaggcacaacgtccatatgacctaaaatcccgaatatttcgtcgccactaccgagttcaatgcgacctgcaacgttttcaacattctttgttgtaaaaccgtcgcggtcagcgattgctaagaattgtagcaaggcatcgcgggggccagggccaagtggtgcgtcgtcttctttatggtcaacgtcgcgcgcactattaatcttgagtaaacttgttaagtcagcaagcatttgatccttatactttgctgcttcttgttgccaattcaatgtcattgcagtcccagctttcattgttaaattttaaccaaaaaacggttaattaattattaatctattcacattttagcatattattacagatttaaaaagcgcttgccattaaaaaataaaaggttcacaaagtctccatgaactctttaaggttagtgcttctttaaaatccgaagtgcgtttaaaatcgcgattaacgttaccccgacatcggcgaaaacggcttcccacattgtggcaattccaaaggcgcctaataataagaagatgcctttgaccactaatgcgaaaatgatgttttgccaaacgatgcggcgggtgtacttggcgatcgaaatcgcagttgctaattttgtcggttcatcggacatcaagacgatatcggcagcttcaatagcggcgtcagaacctaacccgcccatagcaacgcccacgtcggcacgggctaaaacgggcgtgtcgttgattccgtcaccaacaaagacgatttttccgttggtagcgcggtcttctgtgagtttggcgacggcggccactttatcttgcggcagtagttcgctttgatacttatcgatacctaagacggcgctgacttgttgcgcaacgggttggttatcgccagtcaacataattgtttgatgaatcccggcgtgttttagctgcgcgacagccgtttgtgcatctggtttgacggtgtccgcaatgacgatataccccaagtagcggttgttgtaagcaacatggacactggtgcccacttcactaggtgtgagtgttgcgatgccactggcttgtaaccaactagccttaccagcttgtaaaagttgtccgttgagttgcccgctaattccgtgaccagcggtttcttggacgtcagataacgtctttgtgagtggcgtttggttagctgctaaaatcgattgaccaattggatgggtcgagtgttgttcgacaagggcagctagtgctaaaagttcatcaggttgttgatcgaccgaatgaacggtggtgacgctgaaactgccttgggtcaatgtcccagtcttgtcgaaaacaacggtttggacatcgtttaaaacttcgagataattactccctttaaccaggatgccgtttttagaagccgttccaatcccagcgaaaaagccgagtggaattgaaatgacgagggcacatggacaagaaatcactaagaaaatcaatgcccgatagagccaatcgccaaatggagcaccgaataaaaggggcggtacgatggccatgatggctgcaatgccgacaacaattggtgtgtagacttttgcaaaccgcgtgatgaagttttcagtaggcgctttttgactgcttgcattttcgacaaggtctaaaatcttagcgacggttgaatcagcataaggtttcgtgacttcaagcgttaataagcccgattggttaatcgtcccactgagtagttcatcgccaggatgaaaggcgcgaggaacagattcaccggtaatagctgaggtgtccacgtaactgtcgccggtagtaattacaccgtcgagcgggactttttcccctggtttcaccacgatgtgttcgccaacctgaattgcttcgggtgcaacaacttcggtggtgccatcagccgctaaccgattggcgatggttggtttgattgccactaagttagcaattgagcgccgtgaatgattgaccgctaatgattggaaatattcaccgacttggtagaataacatgacaccgacggcttcggcatattgcccgattccaaaggccccaatggttgcaattgacattaagaaatgctcatcgaaccattcgccgtggagaatatttttgattgcggtccagacgatatcgtagccgatgactacaaaggtagctaggagcaacgtggttttagctggtgcgcttagagggacaagataagaaatcgccaagcctaaagcgctgatgagaattcggatgagatcataattaatcgcatgttttgcgggggatggttctggggttggtgattgttgaatccccacatctggttcaatggttggcaaaagagtagcgagttgttgtttgaattcggtggcagcttcttggccggtgagttcatagtttaatttttgagtggtgaaattgacggagcaacttttaacgttggccatcttgttaacgttcttttcaattttagtagcacatgcggcacaatcgatgccggttaattgaagttgtgacatgttattcaggcctccttgttgagtgaaaagctaaatcgtaatctttactaattaaacaaacatatgagcatatattcatattttgactataagataccaccaaacacgatagaatgcaatcgagatgatgggtttgggacatagaaaaagcaccgaccaaagtgaatttgatcggtgtcaataggatccttagtgttcgttgacgtgggcgataacttgcgaaaagatattgatgacatggttgtcagctaatgaatagaaaacttccttgccttctttacgactttttaccagtttcgcttgcttgagtgcacgtaattgatgtgaaattgaggattgcgacatctctaacacactgacaatatcgctcacccgcaattcggattgaaagagggcgtacaagattttagcgcgtgttttatcgcctagtattttaaaaagaattgagatgtgatcaagtgtttcttcctttggaagagtattttggacggaacgaatcaattgttcataatcggatgtcataaaaggtgacctcgttagaatttaatggtagttagttgtagagaacgggcaaactggttaaacagttgcgcgtcgactggtggttgttggggcaattgcagtggcagtgctgggttaatcagtaagttggttggccgcaattgttggggaatttcacggtaaaagtgggttaccatcagcgattggtttgggttgaagtcgattaatgcttggcgactcttgaaccaaccactagcgactttcaaccagacttgattaccaacatagcgcactcctaaaatttgctgttgtgaattggcactaagataaccggttgtctgggtggggtgtagcggattattccaagtagcgacaatgttcgcagttggtttaatctgcgccgttttacccaccaataaagcagcggctttcgctgtttcaccgacgttgatgctgtcgctgaggacaaagcggttagtgccaatgcggtagtaagtttgatcggcaattgtaacggcttcggtgatgttgtagatatggcccgctttagccggctttttattgagggttggttcatatggattttcaacggtggggaggtctcttgaacgtcattgacttgcccaattgtgtcgatggcttcactttctgcttgatcctgtgcggcctgatagtggcgtcccagtgccggatagttcgtgaccacgccgtcgacatttaggttgactaaccagttccaagtcgcttggttttcagacatctcattccagacatacactttttgatggagataatggagctgtttaatgatggttggggtgacgagggatgatgagatgttaatcccgtcggcgtatttaaaactctcgaatgagatccgctgtaaactgccaacgataaaaatgcggggaatctctggcattaaacgttgcatgttttgcagactagcgagggaaaaggaatggaccataacgcggtcttgcatgtgatattgttgaatcagcgccacgagttttgcttccatgtcctgcggatttccctttttggttttcttggtttcgatgaggaatttcgcatttgggttgttttgatagtgctcaaataattgatcgacgctgtgtggtggttccccgttactcattttgagttcactgagcttggcaaaagtattttgcgaaacaatcgcatcggtccccgtgacgcgttgtaagttacggtcgtgggagatgactaagacgccatcttgagattcgtgtaaatcgagttcgacatagttagtgccttgcgaaaaggccatgtcgatactttgaaatgtttcttcgggtgcgttgatggggtcgccacgatgagcgacaacggtaaaaccggttaaaaaccagaaacaaaggcttgttaatactaaaagcccccatcgtgaatgttgctgtgacaaatcaatggcctcctcaattgataaaaactactctttttaagataccattattcctttcaaatgcctacgattgttacagaactttaaagaaacggataaataaattaaaaataacaattgacaacgcttacattaggcggtatattatgtttgtaaggtacttatgcaattacctttttatcaattctctttctctcttatgccaaccactatctgcgggtagtggtttttttgtgtacatattggtagaataaacgtaactgaaatcggattagaataggaagtaacacaatggcggagaagtaccaaacatttgatattattgaagaaattacgcgcttagatggcacaacgtattatgaattggctaacatctttatgaatgggcgtgccgaactagcggctaaccggggatttattaagcaagtccggattttacaactcaacattccgcattcgaatgcggtccaaacttacgaagcttacattaatgaacgttacacaatgcctgcggttgattttgaccactgggaagaatgggaaaaagaagacggcgcagttgcgcaagcctttcaggagattttaaaagcaaatcatattggttaggtgggattgtgaatgacttatttcacagcggatacgcatttttttcacgccgaattattaggtaataatgattttgcgccgcgtccgtttaaagatgtagctacgatgaatgcaacgattattgctaactggaatcaacgggtgcaagctgacgaccaggtttatttgttgggtgacgtcgcaatggtgcccaataagccgagtgcttttgctgaagtcgctgctgtgttagagcagttgaatgggcagctgattattattaaaggtaatcatgataaccgtgcttttttgaaatatttggcgaaacatgatgcgggattatcagctggcaaggcgcattatcaatttgctgatgtcggtgagctaattaagatcaatcaccatcagtattttttaacccactatccgttattattgggaaaggtccaacagacgttcaacttgcacggacatattcatcattatatgttgccgattgcagagaatatcaatgtcgggattgatgcaccagagcgcgaattattacctgaacgggtgccgtttggaacaccccttgcggcaaatgagattgaaatcatttttgaacgcaaacaagccgcgctggcaaaccccagccacgactagctgaagggagtaagtaaaatggaaacaattcatattttacacacgaatgacttacattcacattttgaaaattggcccagaatgcggcgcttcctcttagaacatcaagcagcataccgaaagcaaggggatacggtcttgaccttcgacatcggggatgcaatggatcgtagtcatccattgactgaagcaacgaatggtcagattaataccgagttactcaatcaaattgggtatgacggagtaacgattggaaacaatgaaggaatcggtaatagtcatgctgatctggaacatttgtatgataaggcgaatttcccggtattactggctaatctgtatgaacaagcaacaaacgaaaggccagcatttgcgcaatcttaccgactaatgacgaccgatgctggaacgcgggtagcaattattgccttgaccgcaccatttttcttaacttatcggccgaatggttgggaaccgacgactgtcagtgaagagttgccgcggcaattagtggcgattgaaggtcaatatgacatcttaatcgtcctatcacatcttgggattacgactgataagtggctggcggaacaattccctgagattgatgtcgtctgtggtgcgcacacgcatcatcttttagaagaggggctgctggttaatcaaaccttattgacggctgccgagaagtacggtcattaccttggtgatatcacgcttgaactggatgatcagcaccatgtgatgcataaaagtgctcggacggttttaaccgcggacttaccagttgtgaagactgacgcagcagaaattgaaggctacctgaaaaaggggcacgcacaattagccgccgagcatgttgccaagttgccacacgcttttaaaatcaacgcaattggtgaatcagaaatgatgacgaccggtttaaaggcaattgaagaagcgaccagcactgaagctgccgtattgaatactggcttgttcttgcaagatttgcaggctgggattgttactaaagatgatttgcaaactcaattaccgcatccaatgcatctgattaaagtgacgctcaaagggtatgatttgtggcggatggtgcttgaaatggagaaaaaccggctctttttacgcaagtttcctattaaagggatgagtttccgtggtaaaatctttggagacatcgtttatgacgggatagcggttgatatgaaattgcggcgcgtcttttggcatgggcaagaaattgatccagaagccagctatacgttgacgaccgtcgatcattatctattcattccattctttccaacaattgagattgttggcgagaccgagatcgtgttccctgattttctcagagacgtggtcgctaaatatttaagtaaacattatcccttataagggaagaggaggttcgctgtggcggatacgaaaaacagtcccaagattgccaagaaagtgaccaaggcgattgaaaaagaaatgatcgcttcagccaaacaaccggaagtgccacaacacgttgtcatgaagactgaagccacgcttgagattgataaatgtgcttatgaagtcgttgtgaactatcgtgaaggcttcgacgctgaaaagttgaacgaacgctataatgaagtgttggctaagtacgattatattgtggctgactggggctttgaacaactgcgtttgaagggcttttacaaagcaaccaacaaacgcgctaataaagatcaattaatcaatacgttacaagattatctatacgaatactgcaactttggttgtgcctactttgttttggaacgtcaaggcaagccaatcattaagaatgagaatcggcggagtaatcgccaacgtggtcagcaacggcgtcggcgtcaaaagccaggttttacagaacggaaagtcaccgataacaagcaaaaagtgactaaagaacgccctcaaaaggcggtaaccgagaatcaaaaatcagttaataagcgtcattttaagatccgtcctttggaacacaataaaaagtaaaacgtaattggagttagacaactatgacaaacacagattatgcagggtatttaattgatttagacggcaccgtgtatcgcggccgtgatcggatgccagaagccaaagatttcattgaacgcctacaagcaaaacaaattccgttcatgtttttgacgaacaacactacgaaatcaccagctgctgtgattcagaatttggcggataaccatgacattcatgcgacagttgaccaagtgtataccccttctttggcaacggcgcgctatctattgaatttaaacggtggtacagcgaatggcaaaacggtctacgtgattggagaactcggtttgaagcaggctctatcagatgccggttttagaaccaatgaattcgatccagactacgtggtagttggtttggattatgatgtgacttatcacaagtttgaattagcaacgttagcgattaagcgcggtgcattattcatcggcaccaatgcggatacgaatttaccaaacgaacgcgggctagtgccaggtgctggttcagtgattgcgatggttgaacgggcaacgcaacaaagtgcactctatatcggtaagcctgaaaaaatcattatggaaatggccttagagcaattcggcttgacgaaggaacaagtggtgatggttggcgataactacaatacagatatcaaggctggcttgaatgcagggatggatacgttgttagtttacactggtgtttcaacgccagaggatgtggcaaaagaagccttgcaaccaacgcatatcattaacgacttaaccgaatgggacgtttaaagcgggttagaagtaccactagttgggcggcgttgtatttggcgttagtcagcagtgcgattttaataacgttattgttaagctgggcactttatccgctagtgagtcactacctcaatctagcgagtcaacgggaattaacgcaaccgcggctgatgatgaactttaaccggttaatgggctacttacttgtgccatggcaaccacgcttacaactacctgactttccaatgtcattggatggtcggcaacattttgttgaagtgaaacgcttgtttggtttagcagtagttatttggctagtaacgattggagcggcgattcagcattggcggagtcggcgcaagaccaatcgggtttggcaatacgtccgcccaatgcaagttgctcttgtggtgccacccatattagggtttattgctagtatgaatttcgatcggtttttcattacgttccacgaattattgtttcgcaatctgaactggcagtttgatccaatcactgatccgattatcttagtgttaccggaagtctattttggcctttgttttgcactcttcttcattttgttagagggtagttttgcttggctgttatggcgcggtaaacgtgcgctataacgtttggctttttattaagaaaatgcaaaagtgattgctttgatgcatggattcggtatcctaataagggatatatttttaaattgaaaaagagtataggagaaatcgcatgacgcagttaattgattttgttttacatattgatgcccacctggtcaacattgttaatcagttcggcaactggacctatgtcatcttgtttgccattatctttgttgaaaccggggcggttatcttaccgtttctaccgggggactcgcttttatttgccgctgctgctttggcagcccggactgataatgacttgaatgtctggctgtttgctgccttgttcttaatcgcctcaattgcgggtgattcattgaatgaacaaattggccaacgggtcggtttagccgccacgaagaatcggttcttcggcaagtttatcaataccgagaaaattgaagaggcgcaggtcttctttgataagtatggtggtaaaaccattgcaattggccgtttcatgccgattattagaacattcgttccatttgttgccggtgggagccagatggccttcatgaagttcttccgttacgacgtgattgggagtatcttgtgggtgacactctgttgcggagctggttacttcttcggaaacattgctgttgtgcgtgaacatttctcactcgttgtgttagggattatcggggtctcattgattccgatggttatcacagcggttaagagtcaaatgaaaaaaaataatgcttaataaaatactaaaaagtcctgcatcaacggttaaaacgttgatgcagggcttttttaaaacgtgctttagctagcaacttcttccgtttagccacggtttgcaaacggtcggctgtgcggctcattcactaaccgatgctatactcagaagctaaccgctagttaaagcactcttatcgaaacgtgctccataagccaccttcttccggttagctacggccagtaaatcatcgactgcgtcgctaatttactggactaggctaatcctcagaaggtaatcgggcatattgcgcactcttacataatggacgtgctgtgtagtggttggcgtttttctgggtagagattcgttagtaactcagtcacagccattggtgcttcaccaaatccgctggcaattaacttcactttaccagggtaggtagcaatatcgccgatcgcatagatgttcgggatgttcgtctcgagttgttggttaacagcgacttgatggtggtccaatgttaatccccaatcacggagaattcgagtatcagagataaacccatagttaacaaggagtttgtcaattgttagctgctcttgatcggttgatttcatcttatttaaagttaatgcgagttgttggttcatttcggtcaaactatcgattaaaaacggcgtcttaatttggacagttgattgtttgagtgcttcaacgctactttcaagcccgcggaattgatcccgacggtgaattaaatagacttgtttagccactttttcgagcattagtgcccattcaatggccgaatcaccaccgccagcaacggcaacggtttgatctttgaactgcgccatttcttttgcgaagtagtgaatatagtgattttcccattctggatcgtaatcgacagcgagtttccgcggtgtgaaagccccgttcccaacggcaatgatgatgcctttggtgcgtgtcgtgcccttcgttgttttaagaacgaaagtcccatcttcttggggttcgataccttgcacagcagtggataattgcaaggttggttggaaaagtgccagctgttcaattaagttttcggtgagctgtgcaccagagataccactgaaaccagcgacatcatagatttgcttttctggatagagtgttgcgacttgaccaccgagttcggggagactttcgataatctgaacatcggccttgcgcataccagcataataggcagcaaacattccgacaggaccgccgccaataatggtgatatcaaagagatgatttgaatcaagcatgagataacttccttaatagtagatttcttaaattagtatactagaaaaaaataaggaaagcatgtttaatgaaataatcgtagtaatttatgaagcaattcgctatcataatgattgtgagtcaaaacaaggaggacgattaaatgacatatccacaattagaccttgcaaactttgcagggccaacagctacttttgacacaaaccgtggcgaatttacagtagcacttttccaagaccaagcacctaagacagtagaaaactttatcggcttagctgaaaaagattactatgacggtgtgattttccaccgggtcatcaacgatttcatgattcaaggtggcgatccaaccggtactgggatgggtggcgaaagtctctggggccaacctttcgaagatgaattcaaccaagaagtctttaacttaaatggtgcattatcaatggctaatgctggtcctaatacgaacggcagccaattcttcatcgtaacaaacgaacatatcaaccaaaacatgttgtcacaaatgccaggtgctggttacccagaagaagtcattacggcttatgaaaagggtggtacaccttggttagattttaaacatactgtatttggtcacgtcttgagtgggatggacgttgttaataagatcaacgctacagaaacaggaatgcaagacaaaccagttgaagaagttatcatcaatcacattacgattaatcattaattttaatcgaagaggtgttttagatgctagtaggtggaattgaagcagggggcacgaagtttgtctgtgccgtaacagatggaaaaaatgggatacaagaacgaattagtatgccaaccgagacgccggaacaaacgatgccacggttatttgaatattttgatcaattcgatcatttagatgccattggtttggcatcgtttggcccaattgatgttaacccgaaatcaaaaacatatggctcaatcatcgatacacccaaagcagggtgggaacactatgatatcttaggagcaatgaaagctcattatcctgatacccagtttgcttttacaacggatgtgaatgccgcagcctatggtgaattgaagatgggcgctgctgatggacttgatagttgtgtttacttaactgtcgggacggggattggtggcggtgttgttgaacacggtcagattttacaaggttacagccatcctgaaatcggccacatgttaattcggcaacaaccagaagattcatacgaagggacatgtccttatcaccacaattgtttggaaggcttagcagctggtccagcaatcgaacgccgttggggcaagaaaggccacttattgccggctgatcatcaagcatggcaaatggaagctgactatttagctcaagcctgtgtaaatattgctttaatgctatcgccagaacgaattgtcttcggtggtggggtgtcgaaacaagcccaactattcccaatgattcgtgaatcctttaaacgtcaaatggcaggttatgtgcaaacgcctgaccttgatgactacatcgtgcatgttgcattaggggatgacgctgggattactggggcacttttactagcagctgatcaactttagttaaatgagaacctgagggatgtttcctcaggttctttttacatattatagaaggaattgtataaaaggtcttagccgatagcttgccttttactaactggaaggcttaaaatagataggaatattgaaatggaggaaaatatgggttatcgaattggacaaaagattacaggtactgtaacaggcattcaaccatatggtgtatttgtttcattagatgcaacggtccaaggcttaatccacatctcagaatgtggtcatggttttgttaaagcgttagatgaacagtttaaagtcggtcaagtgttagatgtattagtgttagatatcgatgaatatacacataagattagtttgtcgttacgtgcgctacataaagcacaagatttagcaccacagcgtgctaagaaacactattggacaaatcgccggattcatattgggtttgcgcccattgcaggacgattaccaagatggactgaagaagcgatagaagacttgaataagggtgagaatgtatgagtgctaaagtagccggaacgattatgtataagacagagcaaggacaatatgattttttggtccaagcacaagttgatgcttcttataagatgctggtgaccaataagcaagatgatcaaacaccacttgctgctgtattaattgcaatccaagaacagctaaatattgatgttaacgaattgagattgatcaatttagcgaatattaaccttgaaggtgagaacgtttcgttctttgtctttcagtggggagctcatgagactgatttttataccgaacaattgagaataattagtgaagccggttttcgatttgcgaaccctagtgagttcacggaattactggataagttagaagtcacgagtgtcccgcacttgaattagttcggacaatcggtgaatatctattcaacaatgtacgcttttgaaactttttatatttttattcaaaaaaaagtaaacaatcgcttgacgatgtcttggattgttggtatagtattctatgttgtcagcgagagaaaagctcattgctaacgaaataacgggtcaaacgagattgaataaatattcaaaaaatatttataaaaaatgaacgtaaattgttctggcggcttttttgatggggacacaaaaaaaccagccttggggagactggtttctagcagatccgaagatctaaaaaggagtaaggggtacacgtattactttgggggaataatacgtgcgtggtagattgcgtctaccttaattttactttggaggagtaaaatgaaaaagttaagtagtatgaaatagaaaagattcgcttttctatactcaatactataatgggaatttgtgaagattttgtgaccagaggtttatagatttatgaaaaaagcaataaggaaagtttaaggttcaaagagtatgctaaaatgaaggtactttataagagatcgagaggtgattgatatgacaaaggggaccgttttatttgatttggacggcacgatagccgattcgcaagaaggcatcgtgaacgccttggagtatatgattgaggagttaccattgccgacgcaaaccaaagctgaactggtcacattcattgggccacccctcaatgaaacaattatgcgtgagtttggtttaaatgcagctgctactcgagaagctattaaagtctttcaagcctattatgcgcctaaagggttgtatgaaaatcaactttatcctggcatgcgagaaaccctggcggcattgcaagcccaggatttacaactggcaattgcgacttcgaaaccagaaccattcgctaagaaggtcattgatcatttagagttaggcgattactttagcggtgtttttggagcaagtgttgatgagacaactcgggtcaaaaaagcggatgtcattacttacgcattatcagaacttggtctatcgccacaaactgcaccattattgatggtgggtgatcgccaaaatgatatcttgggcgctaagcaaaacgcgatgaatgcagttggtgttagttatgggtttggcacaatcgcggaactcaaaaaggcgggtgctgtccaaattgtccaacaacccagcgagttaatcacatcattaccggctaatcttaaattttaggcatgctgttgcgcgttagcgaccattaaggtataaatccgcgcgacatctttcgcattgccacggagctcataatcggcgataaacggtgcatcgaattggaccgcataccgtttagcagttaagcaatattgttcgttgaagttgcggttcccgctaccgattactccataacaaaggcgtgcgttctgcgcataatcgatgtattcgcctaagctattggtcattaattctttaacgccattatcaatgccgttgccaccatctaagtaagttggaacgaacgcgtaaaacggttcggtctccgctttaaagggggtcgcatccgaaatttctgtgagggtaatggttggtaacgctgggttattagcatgttgttgcgccgcataatcctgtaaatccgttacaaatgaacgtgtattaccagcaattgaaatatagagaatcgttaaattttttaacattgaatggcctcctgtgactgataagttcactttagcatttaatgattaagaatcctagtcttgaagtttaatagggttcgtgaatagaaagggtgtttaatcaatggaaccaattagtcgtttgaatcaaaatcaaccaagcgtgcgaccacatcgaggtttaagtcgctttttgacgttcttaatctttctttgcgttttccttggcattggtggcatgattctcagcctgacagttttgagagaatcatttacgcaagaacagctcagtgaaccgaagacgttagctgcgatgactgataaaattaacgttgttttattagatgcggcacaaaaaaatgggctaccaactgaagtacaagtcaaattactgacccaatctgatgtgcgggccgatttaaagaaaactgttcataatatttatataggacaagaaaagccgttacccacagcacaaatgatgggacaacttgcagcccatttagaagcagttgtgcctgaaaatgcgttgacggaatctttaattaaaacggcagtggttgcggttcaaccaccactacaagaatacctcacgaaccaaattgaagcaccttacttagcaccactagcgactaagatgttgtttgttagaaatgtgatcaatatcttaacctgggttgcaattattatgggaattgttcttgtactagttcaatggggactaagtggtcaattccggtatgtattagggagtgttggtgcaagttttgcttggagtggcttattcttggcactaggggcggctgcgtttaaatatagtggcattgttgaacaaattgctcaaaaagcgggcgattttaatcaaacaattaccgactatgggttggctgttctggattatggtttgaagacaagcacgattgttttaattggcggggcgattgtctggttggttgcaacgcttctccaaagagtacgatattaaaaaagatgacctttgcgggtcatcttttttaatagggcgtaatcacgatttcatggttcaagtagttagccatgtagatttgttgaagactgtagccttgctgttgaatgtcggcgaggagccattcttcagtttgatcgattaattcaagtgcttctgaattaatctggccgtccataatcagcggatatttaatcgtggcgtcgcctttttgcgtaatggttaattgtccgttttgttccaagattgcgcgactgaccgtgcgaatatcgctaatcccggcaattcggagtttaaacgacagatcctgtgcggataaactattcttagaggccgtttgaatatcaatgtggccgttggtgataattgtttgtggattaccaattacccagcgtttaatccagcgattgtgagtggttagaaacttcattgtgaagacgattaaggtccagatgagtaaaacgagtaagaattgtaagagcgagatatcggcattataaatcataccgccaacaatcccccccaagaacgtaattttggagttgatcaatcccactgctaggggctaaattccccttgccagagaggttgatttgtaacactaaacagaagaaaccgaaaattaatttaatggtaatatcgaaataagatggcatagtaaactccttaatcttgataggtgatgtcttggctaatcaactgagctttttggagttgataactagtaaaattgttatcaaatatgacttggtagttttgatgaccgacgcgcactaccatgtcttgctgaagcgaagtcgtgttgactgcgacggttttaaggctagctttctgcgcagtcgccacacttctaatgaattgcgccatctgggcttgttgcgagtgggcggtgttaagctgttgaatccgtgtatattgaatgccggcgagtaaaatcccaactaagccgaagatgattagtaagtcacggtacttcgaatctgaacggtggcggagatattgaacgaagaagatgatgattaaactggcgatgatcactgacagacttagtttgagatagaattcgaaatcattctgattgctaaagtatgaacaccgataaaaaagcataatgacctccttaaataaacggttaagcctattgtagcacactagctgagcagatagattgtgtcaaatttaaaacggcggtagactgaaagcatgaaagggatgattgatatggcattaaaaataacacctgcagcagttgcgaaaatcaaggataagatgacaccgggccaaaaaattttattggacttagatgatggtgttggtccattttcaaacgttggttattgctcgttggatacgaactttagattgctattagtaccagcgaatgctgacattaaagattatccagatgaatttgaatcaaatctaggggctgtttactacaaagattatgcagctggctactttgatgaacatgaagtattagacgttaacgaaaagaatcagatgttaaccttgagtaataacagtggcttaattgatgggcacatctccattgtcgtatttgagaatgaatcaatgactcattaataactgtggcgtcgggcagaaagtggtccggcgttttttgttgttcatttgtactttatccacattggtgggataatgacaaaaacagttttattgaggagcctgacatgaaaacagcaattgtgactgatagtgcggcgtatttagatccacaagttgccgccgaccataatattactgtggtcccaatcaccgttatttttggacaacaaacttatttggaaaatatcgatatcacgagtgaagcattttacgataaaatgcgcactactgaaaaattaccaacgacttcgcaaattacaatgggtcagatgcaacaggtttttgatcaattgataaaagcgggctacgatgaagtgatttgtatccatctttcaagtggcattacgagctttgtcaataacctaactgcttacgcacagtcggttgaaggcatcgaagtgtatccttttgattccaagattacgagtgccggtgaaggattcttggccttggaagcggcgcggttagttgcccaaggtgaacatgccgcaactatcatgccgaaattggtagctttacgagcaacgatgggcgtttatttcgttgtggatgatttaagccacctcttgcgaacgggccggatttcgaatagtgcggcctttgtcgggaatcttttgcggattaaaccgattttaagttttaacgatgccggtcaaattgttgccttaacgaaggaacggaccaagaaacgggcctttcaaaaagtattagcggatttcaaagcagcagttgaatctgttgactatcccgtacgcgttagcgtgattgacggtaataatccagaagaaagtgcgcagtgggtcgcaacgttgacggaaacattcccaggaatgccgattgaaacgagtcacattggtcctgtggtcggcgtgcacaccggcgaaaaagtaatggggctcatctggagtcgtgattatttagcataacgaaattaaaaaacagccttgcgcatttgcgcaaggctgtttttgtttaaatgtgtgctatcagccatctccttgtggttaatcctcaggagatggctgatagcacactctttttttaattggtttcaataattgtattgttggctgtattattttgtggttcgctggagacttcaaaccagtcgatgtaaccgcgattgaattcgaccacttttaatgtgaattgattgatatgaatgaccgcactttgttgtaagtcggtgaagttttctaagacataaccggccagggtcacgctatctgaggcttcgaaggcatcaattttagtcttgaagaaacgttcgaaatcatagagcgtcgttttcccactgacacggtaacggttatcgtcttctttgatgatatattcatctgaaacatcgtcaatttcgtccttgacggtcccgaatagttcttcatagatatctttatcagtgacaatcccactcgtcccaccgtactcgtcaacgacgaccacaattggggtttgcttattgatcatttgattcaacaaactgtgaataggggttgcttctggaacggagataatcgaacgcagtaatttgctgacgcggattgaatcgtcgacttgtgcctgacggactaaatcatatgcgtagacgtaaccaagaatcttgtctttatcattttcagcaaccactgggaagcggctaaagccttgttgtaagtagtcttttaagacgtctttaacggtatcggtgatatcgacgacgtagagacttgtgcgatcaaccatcacatctttggcaatccggtcattaaagtcaaaggcccgttgcatgtaaactaaatcgttgcgatctaattcaccaccagtgacggcatttttagagaggctaatgatttccgcttgggaaagcacatcactaccttcttcagcaggtgaaaagccgattaatttcacaacacccgttgcggaaatgttgagtaaccaaacaaatggatagaagataatatgacagtaatggaggggcttagcaacagccatcaacatctgcattggaatatcaatactaatattcttcggcacgatttccgtgaaaaccacttctaaataggttaagactaacacgccggcaactgcgccgatgatgtgtaagccaccatttgaaatcaggtgagtgagaccgagcagatcgactagaatggtttcgacggttgattcaccaatccaccctaaaataatcccagcaacactgacccccacttgggtggttgagagatattcgtttaagttttgcgtcattttaagcgcaagattcaattttttaagattaccatttcctgaatggatggcatcttctaaggcacttggccgtgtttggacgagcgcaaattcagcggccacgaagaaggcggctaaaaagaaggtgaccaacataacaaatagattagtgaataactcaccacttgacaaaataattccccatttcttaactaactagttctattttaccattctcaagtttaaaacggtaaataacgtcgggctttagtccgattttatcggattcaataataatgaaaataccataatttagggaagaggtaaactaaattgttaaatatctaaactaaaatacgctttgtcacattttgatgttgatctgtatcgaaaaaagccactgtgttagtggcttttaaacggttttagaatgttgcagtatcaggatcttgcgcgtgtccaacgacgccgtcaagtgcatcaattgcagccatgtcttcattggctaattcgaagtcgaaaacttgggcattttgttggatgtattcagcatgcacagacttaggtaatggtaagaagccgtgttgtaatgaccaccgtagtgcaatttgtggaattgagcgttggtatttgtccgctaattcttgcatttctggcacactgaaaatcttcccagtcccaagtgggctataagcttctaataacatgccatgttcacgtgagtattgggcagtttcaggttctaattcgccaggggctaagaagagttggttgaccattggttgtaccgttgcagtctttttgagcgcttctaaatggcgaacacggaagttgctgaccccgatggcccggactttaccagctttgtagagcgtctccattgcacgccatgtttcggcgttggctgtttcccaatcatcacggtaggcaattgggttgggccagtggattaagagcaaatcaacgtagtcggtttgtaatttcttgagtgattcttcaaaagagctgattgttaaatcataagtgtgattactattccagattttggtggttaggaataaatcggaacgatcaacgccactagcttggatggcctcaccaacactcccttcattaccgtaagcttgggcggtatcaatgtggcgataacctgccttgagcgcctcttcaacagcagctacggctgtttgaccgtctggtgtttgccaagtcccgaagccaattttaggaatttgcacgccgtttgtaagcgtgtatgaactcgttaagttagacatattaaaacactcctttatcagtttaaaatctctacttacagtttacttgttttcgatagagatagacagaaaaccgacttattccccggaaaataaaatcgatttgtcataagctgagcaatttggcctgaagtgcgggatcaacagcatagaggtaaaggccgtttctagcgcggctcattagaacgtagaggctattaagaataatttgctgtttcgcggcttcaggatcagccagctgagctgcgccggcaaatgcggcttggtcctcgtaatattcaggatgaataactagccgctcactttgtggatcatacgtgacggatggcccgatgatgacgccggcatagttgagatcaaagccttgaatggtgtacacggatccgacttcatctatactatcttcacgttctgcccaataggttttagcggttggctgataccgatcccagcgtaatttgaatgtcgatgtctcaacgaagtgctcgtgaccatcattgagtgttgctggaaaatcgtaagtagctagcatgcgtgcaagcccactcgtttagtttttaaagcgaatcgtttgatagagctcattggcatcagtgaatactttgaattcaaagtgtggatcatgtggcagggcagcgacttgttgttgatgaaaggtttgcacccaattttcaacacttggatgggcttgcatccgaaattgatgggttagttgcgcggtctgatggggagcagcttcaattcgttggcggagttgttgctgttgccagaagctcttcactttaagcacttgctgttcatcaaaaatcagaatggtgatccgactgtgtcggcgaatttcatcgagttgatttgtttgattgaagtgcttataggggtcggatttggttaacagtaggtgtgcctcatcaacgaggacgatatcggcaagttggtggtttttagccgcttgattgatgaatgtcgttgggcgttggaaatcttttttcaataaaacgggtgccattgttgtgccgcttttgtagagttttaacatttctggatgattgaccaatagaacgttttgactaccatagagtggcgaggtgggtgtttggcgcgcaagtgtctgcagtgccttgaagacactgctgagaatcacgcttttaccagtcccggccgcaccttgaatcaagaaggtggcgtgttcggcgtgcgcgtttgccaaacaaaattgaatgacttgttcttgtagtgcttgttgttccggtgttagttggttggcgggacgattgagtttataaagcgcgctattttgacgctgtgcatttggcaaagtgaggactcctgttcattcatttcaataaaaaaagccctagtagatgtagaaataacatcgcctggggcagtggtgctaatcgacaaaaattagttggaattcatgctgcactaaatcgagattgacggagacgtggcggttgagatcggccacaattttacgcgctaatcttacccgttcttcgaagcttgtggcaagtgccgcgaattcagtttgtttaaagttgtagttttcagtgataaaaatcgcgtctgtgacatataacaggttattttcatcgtgacgagaaccgctctttaaaacggcatcgatataatggtaaagctgagtaggggcaaagtttaatggttggtctaaaacggttgtaatctgaaaatcaggtaaatcgtcaaccatttgtgtgtttagtgtgacttgggttaatgcttgatacagtttcatagtaacaccttcctaatgttgagatttaaggccgtgcttgtggagcttctaagtggcgttgaataaagcctaacgtcacatcagcgataatggccatcagggcggttggcagggcaccagctaagattaaggcgccgccattagtggcgttggtcccgcgaataatgatgtcgcctaaaccgccggcaccaacaaacgcgccaatcgctgtaatcccgatggcgaccactaaggcattgcgaatccccgccataatgacggccaatgataagggaagctcaaccatccgtaacagttgccaatttgtcatgcccatcccgattccggaatcgataatattatcggaaacattctccataccagtgtaagtatttttgataatcgggagcaaggaatataaaaagacggtcgcaatgacggttcgtgtgccaagccccaagcccagcataatgattgagagcattgcgagtgaaggcactgtttggatgacattcgctaccccaattataacattactgagctttttccggtgcgcaataaaaatccccaagggaatgccaatcaacgcggcaagtaaaacgccataaatcgaaatcaaaaaatgctgactaaactgccgtaaaacataactaccattatgctggaaataatagacaagttgttgccaagtatttaaattagtcatttagcggctcctttccggaaataatcatgttcctgaagaaattgttttgcgaccactgcgggttctagtagatcattatcaactttaaagttgagggtttgcatggtgtcgaggtcaattttgccatctagacggtgtaaaaggggcgctagtgctggctgttctttgagaatctgatcagtggcgaccacgctcgtatcatatggtgggaagaagcggcgatcgtcttttaagacttttaagtcataacttttaatccgtccatcggttgagtaacctaagacgacgtccattttaccagccgccagcgcgctgtaaaccagtccgatttgcatgggcgcaactttcttgaaatcatagccatacgtttctttaaatgcgggatagccatcgccttcgtgatttacccagacggaatcgacaccagctgttagttgatccgccactttgccgagatcgctaacggtttctaaatgatatttcttggcggtttcctgggtgaccataaaggcataggtgtccgcaaatccgtaggaagggaaccatgtttggttgtaacgatctttgaaagcttttttaacgattttttgggctttttcaggatctttagtaggcttcatttttaaagtaccagtaagttcagttccagcgtagcgactagcagctatgtcggcgtcaccacgaattagtgattcatgcgttaccgttgaagaacccagattattaattaaagtgaccttattttgtgtttcgtgggtaatcaactcgctcagaatattggcgagaatttgtgactcagtggtgcttaaagagctaatgcgaattgtttgtgattgacggtttccgatgccaagtggctgacagccacttaacaggaggagactgccaactaataatccgcaactcgtaatgaatcggcgtattttatgcataggagcctccttatctgattgcagcgggggtcagttgtttttccaaccggcccaagccaaaatcgactagcaatgctaacaatgtgacgggaattgtcccgccgatgattaaatccggtttgaaaagattcaacccgttgaaaatcaagtcgccaagaccgccagcgccaatatatgaagcaagggttgcccaagcaatcacgtaaaccgcagataggcgaattcctgccataatcacgggggtcgccattgggatttccacttgcataattgattgtaccggcgtcatgcccattcctttagcactatcttttagaatcggatcgacatcgttcatgccgatgtaggtgttccgcaaaatagggagtagtgagtagataaataaggcgatgattgctggtactttgccaatcccaaagagcggaatcattaaagccaatagtgccaatgaggggacggtctggagcatgctggcaatggcaatcactactttggcagttttaggaaatcgggtgagggcaatcccaaggggcaccgcaactattatgcccagaactaaggcgattgcggaaatgtagagttgttcccaagttttaatcagtaaatcagagccatgttctgttaaaaaagtgagcatcatcgattcctccctttctattgttggtcggattctgcttcagattcgtcagtatcaccccagacagcatcataaacgacatcgactagggctgtccgggtgacaatcccaacaagttgatgatcatcgttgataacgggaacgtatttccaaccccgtttaagaatccgttcaatggtatcccggaccaaatcattttcgttcacgtaactaatcttggtagacataatgtcaccaacactagttgcgtctttgtagtgatggtcgatattttcaatatcgacgagtccctttagatgttggttttcgtcgacaaccagtaaggtatcaacgcggcgttggcgcattaagcgaatcgcatcaactaatgatttacctggtgtgatagcgactggacttttaagcatgatttggccaacagtttcgacatttggtttggcttcgatcaaacgatcgtgaccgattaagtcttcgacgaattggttggcaggatttcgcaagatttcattgggcgttcccatttggatgatttggccgttatccatgatggcaatgcgtgacgctaatttgagtgcttcatccatgtcatgggtgacaaagacgattgttttaccgagttctgattgaagttgttttactaagtcttgaagtgcctcacgcgtaattggatcgagagcaccaaatggttcgtccatcaaaataatatcttgtccagctgcaagtgcacgaatcaccccaattcgctgttgttgtccacctgataattggcttgggtaacggtctaaaaagtccgcaggcatttccactaattttagtaattcgagcgcctttgcatggcgtttttctggggaccattttaagagtttagggacaattgtgatgttatcttgaatagtcatgtgtggcattaagccaatattttgaatgacgtaaccaatttttcgccgcaatttaacggggtctacattagcgagattttcaccatctaaggtaatcgttcctttggttgggttaatcatgcgattaatcatccgcatggttgttgttttcccagaaccagacgtcccaatcaaacaaatgaattcgcctttgtcgacagtaaaactgatgtcatcaacggctttgttaccaccgcgatagagctttgaaacgtgatcaaacgttagataatgtgtcataaggaacctcctattgtgatgattggaaatttattgctatataataactatgttagatacctaacatgcaattgtcaatgaatacgctttactgataggtgtgaaaaagccggtgtaacggaattgagaacgttacaccggccattaattaacctgttgatttaggacgataaagaataaagtgggcgattaaagcgagacattgataagctaacgctaagagacaaacggcgacccagccaccgaagctccaagcgagggcgccaaagaatgaaccggaagcaccacccatgaaataggcaaacatgaagacggtattgttgcgactactagtggcttcaccaagcatttgggcccgggtttgattggcaacctgacggcactggtttccgacatctaataaaacaatcccgagcattagaatcggcatgaaatgcccccagaataagaataaaagataactgattgtcatcatgaataagccagtggcgataataaagcgaggtgatttagcatcggctaagcgaccgataattggtgcagctaaagcaccagccgcaccaaggattgctaatagaccaacggtaccactaccgagacgatagacgggactggccatatagaaaatgagtgtcgaccagaaaatactaagggtcccaaacatgaaaaaactgttgatggcggcttcccgtaacagccgctggtggcgcgacaagccctggaattgaactgattgtctgccagtagctgggcccgttttttggacgggaatccttaggtaatttgagggctgccagaaggattaaaagcgcaatcgcaattgtagcgatgagatacacccaacgccaatgaatgtaactactaataatgccgctaaagcttcgggataggagcacacccattagaagaccactgagaatggtgccgagcactgcaccccgtttttgtggttgagcgaggacggctgcatatggaatgatgatttgaggaaccactgaggtgaggccaatcatcaaaccagtcaaggcaaagaaaatgaaattgggtgctagataagcggctaataaggatagtaaggataagccaagcatccgtaatatgagctggtaacggctcatcacatcaccaaacgggacaatcagcaacaagccaagtgcataaccgacctgtgtcaacattgcaacagtcccgaccgcaccacttgtaacgtggaaagtggtcgctacgagtgcttgaatcggttggatgtaatatagattggagacggcaacgccggtaataaaagccatcaaaaggattaatggctgcgtaaggactgttttttgcggagcactttctgacatactagggtggacctacctctctgaataacgttcttttagaatttgaagtgcattgtcgaattcaacttgggcttccggttcttcttcacgctttgcggctgtttctagaaagtctaaaatttcaggcgtgacatcgcgcactaattgactgagcgcccaagcagcagtgccgcgaatgacagggcgcggatcagtatcgatgagttcgagtaacttcggaatcgcggtgcggtctttcacgttggcgagtgcgataatcgcattgcgttgaagtggctttttgccacgccacgaactagcaaggtgtccaaattgaagtttgaactgcttgttactgatggttagcatgggctgtaattcgggcatcacagattctggatctggctccatatcagggtggaagtggaagtcttttcctttattaaacggacatacttgttggcaaatatcacagccgtaaatgacactgcgaattttcggtctgaattcttcgggcatgaaccctttggtttgtgtttgataggataagcaacgcttggcattgaggcggccatcgcccattaatgcctgtggtggacagtaatcgatgcagcgcgtacagctgccgcattgattggccatcggtgtgtctggttcaaatgggatgttggtaatgatttcaccaagatagacataagaaccgaattcgggtgtaattaataaaccattcaaaccgatgaagcccaacccagcacgttgcgcaacagccacatcgctcagttcgcctgtatcaaccattggcttaaaagtaatttcagtatctgagtcagcaagcgtttcgatagcactgatcagctggtccatcttatcgcgcagaatatcgtggtagtcaatcccccacgaagcgcgggcaaaactaccgcgtttagcaccagttcgcgctggcttattggtgatttttgttggataggcaagagcaatcgcgataatcgatttgggttggtcgaaaattaaatctggataaaggcgttcttcaagcactttatgttcgaacccagtcgagtgaccattcgctttttgttccttaagacttgcttctaaataatcaaaaggcgctgccgatgtgaaaccaatcttatcgatgccgatggttttgctcgcctcaatcacttgttcttttaaagtgggcattcaaagccacgctccttttttgagtttcatgtgaaacaaatgggttatgctaaataaattttatgtaggtcagctaagtcgtgttggcttaactggagatcgtgtgataaatagtcttgcaacgaaccattttcggattcaatcgcttgtttggcggtatcgaggtaatcttgatgaaccgttagtaatgactgataactttggaacacagactggttctgtgttttttgttgtagttttgcaagcgattgggtcacgaaagcggcagaagcttgattcgttaataagtaatctgtgcgaatcgtttcttctggaacaccgagtgcactcaacaagaaaacagcgcccatcccagtacgatctttaccagccgtgcagtgaaacaataaggattggtcctccttatcgttagctagcaacaagtcgaaaaattgccggtaagcttgcttggagtgatcttggttaattaagtcggcatagacttgaatcatatgttcatgaccactttttggatcagcactgaacgttttaaaaagatcagcctctgatgccgtactagccgtttcatcaattttgaaaacgggtaaggattcatagattgcattggcagggaccttgtctggtgacttggcaatttcttcaggtgagcgaaaatcaacatcatagcgcacgccataatcagttaaataagctaaatcatgtggtgttaggtgggctagactagcggaacgtaagactttatgccatttaagggtccggccgtcttttgtttgatagccgcccaattctctaaagttatggcctttttcaagtggcaaaatgcggtgtgtcatatgcgtcaactccttatccaatgataccaatattgtagcatatttaatgggcaatcaacttaacttgtcagtatgtggggagaaacagtatgataggggtattaagagtggagtgagcagatgattacgtattttgaaatgacacctgagggccagttggttgaaggaacctctgaaaaaagtgccgactggattcattttgaagcaccaactaaacatgagatgcaccatttcgctaaaaaataccacttaccagcggtgttatttgaggtggcccaagatatcaatgaagtcgcacggtatgaaacatttacaacggacaccggtgaagtattgacccatatttgtttactggtaccagttaaaacccatgattcagaagatcatgcggaatatattacgcggccttttttgttaatcattagtggccagacgttattaactgtggggcatcaacagtccgagctcatcgatgaaatactcacgttagaaggcctggatggtcaaattgaaacggttgttctaaagagtgtttcggccatctatcaacgttatttagcggctttagcggtcgttgcgcaacagattgaacaattggaagaaaatgtacatgtttcgacacgcaatcggttgttgtatgcactcaagtctcttaaaaagagtgttgtctatttggatttagggcttaagagtaaccagcaaattattccgcaaattaaggcaagtccattatttgagcgcgtgtcaggacatacagacttactgtatcggattgacttgcagtttgccaagtccgataaggcgattacaacgtatcgtgaattattggcacaattaagtgatttgctttcagatattatttcaaaccgattgaataatattatgaagacactaacatcactctcaattattctaacggttccgacaacgttaggtggtttctgggggatgaacgtaccggtcccgctagccgagagtaagttagggtttctcgtgctattaggattgtcattagccattagcctttgtgtcggttggtggttaaaaaagaaagactacttctaattaaatgttcgcggaagcgcttcgcttttttgcttgaattgtttttccaagcggtatattcttaaagtgtaacaggtgcatatagagaaagtgagatgaacaacatggttcaagaatataaaagaatactcgtcccagttgacggctctgaagaagctgaattagcactaaataaagcagtgtgggttgctaagatgaatcaggcgcgcttggatattttgaacgttttggataccaagcaatttgcagggagttatagtggcatgctttcaggagacgctattttccaaatctctgaagatgcacagaattatctcaacagtttaaaatatgatatccaaaccaatgacggtttgaaagatgtcgagattcatgtgcggtttggtaatcctaagaatgttatcgcacgcgacttcccgacagaatatcaaaccgatttaatcatgatgggctctactggcttgaatgcagttgaacggatgttgatgggttctgtgacagaatatgttaaccgcacagctatctgtgacgtgttaatcgtcaagactgatgttgaaaatcgcccttatcaaaaagcaagtaagaaaaaataaataacaatcccaaaggctaaaaaggatgaattctttttagcctttttgcgtagttcaatttaggaggtggtaataatgacaaaagctgattggatgtatgattcacctgaattattggcgtattaccaaacagagtggggaaaaccggaacatgatgaccaacgcttatttgaactattatgtatggagttgtatcaggctggcttgagttggcggactgtattaaataagcgtgctgcctttcggacagcatttaaagactatgaaattgccaaagtagcgcagatgacaccaaccgaaattgagcagttactgaccaatccggcaattatccgcaatcgtgctaagttgaatgcaacggtcaataatgcacaagccgtccttgcgttacaaaagagtgcaggaagctttgatcagtatctatggggctttgttgatggacagccaattgtaaaccggccccgaacttgggcggatgtccccgcaaaatcagagctatcgatccaaatcagcaaggatttaaaacggcggggctttcaatttgtcggaccagtcgtcatctattcattcttacaaggagctggcgtaattgatgatcatctgatgtcacagtaactttttggtgcagtcagtcgcgctaatattgcggatggtgtattatggagggatagaattcatttagattaattaaaggagtcccacatatgacacaggataatgttcgccaattagcagattggttagaagaaaacatggcagcaattgccgatcgcaaagtgcaattaaatccagaaacaatttttgctgttttggatgattttggcgttttaaataacccggtcgttaagtattttgatattacagaagaaacatattatcaatcagagtcagatcataaattaacgttatcagatgaccacaaattattaatcgatgtgaccgatcggattatggtgacccacgtggatggtgttttagctgaaaacaaagtcaactttgaatacagccacgaagctgtttatgaagatcaatatctcgttaaacgcgatttagaagtgttgacatatggtttggctgtcattggtgcagtggctgcaaccgttaaacataacttaatccaagctgatttgtctaaagatgctgtgttgagtttagctttggctgcgcaaaacatcgctaattggcaagcaaaataatccagtaaaggttggcaagttaaatgggagcagtgctagaattgcgtgatttttcgcaaaaatatcagcggcgacaactttttaaacgtctcaatttacggattgatcggcaagcttgtatcgcgattactgggcaaaacggcgcggggaaaaccacgttgcttaacgtactagcaggattgacgaatattgaacgcgggacactggagattgcaccgaagatgcggattggctatatggctgaacaactcgcaccaaatggactgacacctaagacttatttgcggatgctaggagaattagatcagtttagcaatcgaaatttagaaggtcagattaatgaattagcctatgaatttgggttagcggcggcacttaatacaccgttaaatcaattgtcacgcggtagtctgcaaaaagtgaactttgtgcaggcgattttgcggaccccagatattttattgctagatgaaccgttggctggtcaagatggaacgacccagatgcggatgattcattggttgaaagactaccgccaaaaagggggcgccatcattgtcggcactaacaacgcttttttaatcgaacagttggctactgaaatttatgaactagatgcgatgcggctattgccgattgaagaattaccgcagccggaagaaaaggtgatgcggttagaatttgcaactacaccgcgatcactcgcactccccgctactttacaacagttagctttaaaaattgttgatggtacgcggtacgtcgtcttgtatgcaaatatcaaaaatagtgatgaattaattcaagcaatgttaaaaagtggctttagcctaagggggttacgttatgaagtcctttagtgcacagttacgtttgcatcagaaaatggtttttgataatgggaatttgtgggggcctttgctattttggatagtggccttattagtcaattatgcggtgcaaccacaagatttcgtcggcagcctcgctacattattaatgacactgtttatcttattgacgtggttgacctacagttacatcaatcaatttccccttcaaatggaaaaacttttaattttaaaattaaagaagcaacgccgtttttatctcagtttaattagctatctcatcttgttgggattattctttgtcctaattgggatgggaagcttggcaattacttacgtgctcaatgggcaccacgcttttggtcgaggacttagctggtgggattggctaggcgggaccttaatgttgacgagtattttacctgtttcagtaatgaccggtttgttctggcaacggcgaattttagtgaatcgccggatggccggtacgttgaccatcttgatggtggttctcggcagtttaggtgaagcgattgtcaattactggcatccttacctctatattctggggattttgccacccgtttcgaccatggcgcaactcttcaacacgttgggacacatttcgctagttgatattttattatcatgggcaatgagtcttggttatagcttggtcttattattgattgatcaattaattttaagaaggcgtaaattcctattttaagaagctgacaggctgctataagcggtttgacagcttctttttaagttgaattaagcggttacgggtgaaaaaatcttaaaaatgtggcatgattaaaaagaattcaaatcataaaaggagcttttataatctatgacaaaaattgcaatcgctggctcaggcgcaatgggcagtcgttttggttacatgttacaatcagctggaaatgatgttgtgttacttgataattgggcagaacacgttcaagcaatcaataccaatggcctgacggttgtagaagcggggcacgaacccgttcaggttcgaattccggctgctttgccaacggatattaaagaagttcaagacgtcattattttattcacaaaatcgatgcagctagtcgacatgttacaagccatcaaacccttaatcggtgctaagacaaaagtagtctgtttattgaacggtctcgggcatcccgaaacgattgaacaatacctgcccaaagaaaatatttttgtcggcattacactttggacggcggggttaacgggaccaggtgcgattacattaacaggctctgggaatgtcgaattacaaaatgttgatccagatggcaaagaagcggcacaagcattagttgccttgttgagtgcggctggcttaaatgcgcaatatagttcagatgtactcttttcaatctggcgtaaagcctgcgttaatgggacactgaacagcttgtgtgccttgttagactgcaatattgcacaactgggccaaactccacaagcgcaacaactcttgcgttcaattgtggcggaattctcagcggttgctgcaacagaagccgttgaattagacattcccacgacgattgcccacatcagcaagatgtttgcaccagaacaagcaggtggtcattatccttcaatgcaccaggatttagtgcaacatcaccgcttaaccgaagtggattacttaaatggttacgtggcacgcaaaggcgccgaaaagcacattgcgaccccagtcaaccaattaatcacggaattaattcatgccaaagaagcattattgattaaataaacgaggagtcttaactaatgacagaaaaacgccaattaaatatcgaagttgaatcaatgcactatcaaaaattattaattgctatcgatgatgatgatacaacctcatccaaacgggcctttaactatgcttgtacgcttgctaaggcctatcaaattccattagggattgtcagcattttggaaaccggcgatttgaacatttatcaatcactctcaccaaacgtggttgaagggcgccgagaagaaatcgcagccgatctagatgtttatgttcaaaaagcgaaagaattcggggttgaagatgtgatgccgattttaaatgaaggtaatccaggacacgtgattgttgaagaagtgattcctagtttccaaccagacttggtcatctgtggttcaaagacgaaaccatctaaacatttaatcgggacacatgcgagctatttagcgaaatacgcgccatgttcagtcacagttgtacggtaaattaagtatttggagatcagacgaatgatagaatgtacacaatgccatattaaatacgggcgtaaattacaccagtgtcccaattgcggtctagtgcaccaatcaacacaagcaaaacagcaaacctcgctactgcaacaatactatcaatttttagcgcggagtttaaaacaaccgctaaaggtgcaatggcagtgggccaacctgtggtttggcttagtcacgtttggtctggttatattaatgaatactgcaacggcaagtttgctcattgccagttggtcagaacaagttggtgcggttgctggggtgatggcgtcacaaattgtcttgcgcctacggccaaacttattaccgcttgatatgaaggcactcggtggacaactatttattctggtggttgttgtgggaatcggctttttactcaagcgttacttattgaagaagacgacaaccaccttgcgcgcgtatctaacggagattagtgcgtacagtgggataaccgtcattttagcattagctgcgctgttggctgctctatgtttcgggatgaccgccatctggttcgtcttaatcatggttgcagtgatgtacgtcagtttgaacattgcggttgggattagtttatttcaaactcgatgggccgcttttgatcgcgtctatgctattttattatttgaaatcttaacccatgttgtcttggcaattggcattagccaaatcgtgattttaaacctactaacaggactctaaaaaataaaagtgcgtattttggtacactttttcaaaagaggtttatcattagagttgtaaaaaagaaatgggaggtttttaatatggcagcagctgttgaaaaaacattggttttagatatgaagatgtcagaagcatttgattggagtgacgataacacaatcgtccgtgatgctttgtgggatcactatatggaagccaacggccggaacacggataaaaccgttgaggcaatgaaaccctatcttaagatgagcgacgcggaagttagagaaaaggcagaagcgcttttaaaataaggcaataaaaaaagacccgctcggtactaaaacttcggcctccgaaaattaaattaagtaatttaaattgaaagtcaaatttgttcgtacttttatgtccggattcttgacataggagccaacgtttggtaatgttttatcttgctcccatctagaaaccgtttgacgtgtaacaaacaatttctgtgcaacttgttcctgcgtcaccccaacattcatcctagcttcctttaaagcattcccaactgacattttgccacctccgctataaacctaatttaacgaattaacccccacaaaaacaagcaacaaatctgttgcatccctgctattaaagtatttcaactcattgacagtcttttatttcccgggttaattcccgaaaacagctaacgttttctttgttgccttttgggtcttcacgagttcaccttgaatacaccatctgcggaccgttttatcacaggtaatcaatgtcaccattttacgacctggtacatcatcgatgacttttacgtcgtatggactgattgaagctttgtaatcaactttgtacgtgtagactttttccatatccgttaagtagaccttatcgccgacacgcacattttcaagtggcagaaagatgttttggaaagaatgccctgctaaagcatagttgttaactgcacccatttgctgatcaggtttcattgtgcccccaccttgagccattgtatcctctgagacgcctttcatgactggcaaggccatcttgacacttggaattgcaacttttcctaagacaatcacatcgcctttaacagcggcattcacaatctgttttgtatcgagtgaatcaaccttatcataatcaaagctcgcttttttatgttggtttttcttaatttgagcagctgtgacgtccatctgacgatgtgccatcattttaaccagtcggttgcggattggactgatgaagaccaacactaatccaaccactaacagaatggctgataagccattaattaatcggttttttgtctttttttgcataacagtttaaacccttcactagtatttacgactattgtaacacactattttatatttaccggctctaaatccttgtgattcgcaattaataacggcaacacataaaaacgcacaaccgaaactctcggctgtgcgtttgttgtttattttacgtttaagatgtacataaagaccacgaaaacaaagaataaaacatacataattggatgaatttctttgcgacgaccagctgtaatcattgtgattggatagacaataaagcccaacgcaatcccgtcagaaatactgtaagtcagtggcatgcctagaacgattaagaaggcaggaattgcaatttctaatttttcccagtcaattttcttcaatgattgagccattaaaacaccgacaatcactaatgcgggggccgtcacttgtgacgtgacaaccgtcaataatggtgagaagaataaactgaagacgaataacacacccgtcacaaccgccgttaagccagttcgaccaccaacagcaatcccagcggacgattcgacaaaggccccaactggtgatgttccgagtaatgacccagctaacatggccgttgaatctgataccaaagctttcccaacgcgaggcatcttgttatctttcatgaagccggcttgttcagctaaaccgaccaatgtcccggcggtatcaaagaaggtcactaataagaaagtgagtacaacgacccacatttgaacggtgttgatatcgccgacgtgatttaaaccagctaagaaagtgggtttcaaacttggcgcagctgcaacaaagtgtgttggcaacttaattaggccactgatggctcccacgattgaggttaaaagcatcccgataaagattgctcctggtactttacgaaccattaaaataacggtaatgattaagccgaaaacagttaaccaagtcgtcccttgcgaaaagtcccccaaaccaacaacggttgatttgttcgcaacaatcaagccaccaccgtgtaaaccgatgaacgccacaaacatcccgatcccagctgaaatcgctagtttcatattccgcggaatggcatcaataatgatttcccgtagcttaaagacagtaatcaacatgaagattaatgaagccacaaatacacccgctaaggccgtctgccatgacacacccatcccgataaccactgaataactgaaaaaggcattaatccctaaagctggtgcggttgcaattgggtatttagcatataaccccatcaagaaacacccgatcgcacttgctaatgctgtggctgcaaaaacagcccctttatccatccctgaatcacctaaaacgctcgggttaacgaataaaatataaaccattgaaataaatgtggtgaatcctgctaggatttcccgttgcactgttgaatgttgttcttcaatcccgaagaaacgacttactctttccataacgactcctctaaatcaactaattttcccactatctttttagtggtaatgtgtgtataatactgactggtgccaaacccatgagaatgaaagtttgttggcgtgtttaacgacacgtttagaaaacgaactttgcattctctttttttgtactctttttcagcaatacctaccagatagcagataagacatttgtttgttcacgatctggaccaacagcaaatgttgctaatggtaaatcaactaattcttgaattcgttcaacatagtgccgcgcattagctggcaagtcttctagcgtcttagcacccgtgatatcttcatcccaaccaggtaattcttcataaatcggtgtgcaacgttctaattcgcggagacttgctggataacgatcgatttgttcgccatctaattcgtaagcgacacagatcttcaatgttttaatcccagttaggacatccacacagtttaatgataattgggtcacacccgccactcgttttgaatgccgaagcacaactgagtcgaaccaaccaacgcgtcttgggcgaccagtaacagtaccatattcatgaccggcttcacgaatgaagtcgccagtttcatcatctaactgagttgggaatgggccatcaccaacgcgtgaggtataagccttagccaccccaaccacttcgtcaatccgtgaagcaccaactcctgaacctgttgaaacgccgccggcagggtttgatgatgtcacaaatggatacgtaccttggtcgatatccaagaggatgccttgtgcgccttcaaataagacattccccttttgatccaaaacatcattcaaaacaactgaagtatcacaaacatattgcttaatttcttgaccatattgataatattctgcaaacattgtctcatattcaagtggttcagcgccgtagattttagtaaagagcgcatttttttcgtctaagttttgttttaatttagttgcaaagagttccttgtccaataaatcggcaatccgaatcccactccgagcggctttatccatataagccgggccaatcccacgattagtcgtcccaatcttttgatcacccttggctgcttcttgtaagccgtccaatttagaatggtatggcaagataacgtgtgcccgatctgatactcttaattgactcacgttgatcccttgatccgttagatatttcaattcagaaacgagggtcttcggatttacaacgaccccgttgccaatcacgctgagtttgtcactgttaaaaatcccagatggaattaattgtaaatggtaagttgtgtcacccaactgaatggtatgacctgcattgtcgccaccttgataacgcgcgatagcaccagcattttgacctaaaaagtcggtaatcttgcctttaccttcatcgccccactgtgttccaacaactactacagatgtcatataaacatactcctctattcgaatccgtcttcagatccgctatttaaaccctaaaactcacaaaaactattgtagcaacaaattatctcaaaatcaacataaaagacgaactttaaaatctctaatcagcctttattccgtaaaatcttaacgatacatataaccgataaaatacgaacgtaaatcacgaacaataatccctgttttgacaggcgttcattaaaaaaatacaatataaccacatctaacaccaaaggagctcatcatggtttacgtcagcaatatcattactgtggcaattgcctttccattcgtcgcaatcatcttaaccgttccactgttagtttaccactatcatcgttatggttcgctaaccatcctgcgtagtgtaattctctacagcttcatgttctacttggtagccgcttactgcttaattattcttcccctccccccacgctcggtggttgctcatttaaccaccccgcgttataacttagttcccttcacgtttgtccgggggtttatcaactcaacccatttcgtttggaccgaaccgagttcatacctcgcaacacttaaacaaacgacaaccattcagccgttgtttaacatctttttaaccgttccatttggcatttatttacgttacttctttaaaacgtctttcaaacagaccttattacttagttttacgttatccctattctttgaactcacgcaactttccggactgtatggtatttatcctcgcccttatcggttatttgatgttgatgacttattgctcaacacctctggcgggctgcttggattttatctccagcccttggtcacctttttcttacccactcgtgaaagtttggatcaagcaacctatgcgcgcggtcaaaaagtgggctacttccggcgcttattggcattagtcgttgattactgcattttaggagttattacctttatcattgcccttatctggcgactcctcaaactccccgccattcattcagaaatcctgcaatactgcctagcaacgggtgtttacttcttaataatccccattctttggcgcggcaaaacactgggcaaggcactcttacaactacaaatcgtcgccgatcatcatccacgttgggcaattttctggcgccagctactcctatttttcatcgtcattcccagttttcaactctggcgcgtcactctggatgccgctgttgctagtggccaacaacattttgacgtctatctctttattatcggtctctcactcttaccaccactgttattcaccggtaacttcttattaagttgggtgactaaacgaccacaattattctacgagaaactaacccatacacgggtcattagtagcattcaccccactcagcaaccttaaaaaagccttaaaatcatctttaattcctaaaaatagttaaaatcggatactttacggcttgaattggctatactaaaggtatcattcgctttgagaaaggattattgcttatgtttaataaattgaagttcctcatccccattgcatttactgctattatcggtctgagcgcacaaccggcctttgccgacagcaccacatcgtgggacaaacccgttgccactcttgggaccagcctttctagcacccaaaaagctgacaccctcaagacactggaaaatgccgcgaatgtcacagatgtcagtgaactaacagtgaccggctccacacttgtaaaatatcttgatcaaaatcaacaaacatttaacgccgactcaagtgtctactcaagtgctttaattcaaaaaaatgacagcaataccggcatcaatgttaaaattatcgattttaatggccgtaacaacatcaccacaattacagccaatcaatataaaaatgcggccttaaccgccggcgtcacgaatgcgacaatttacgtgacttccgccattccaatcgatggctctggcgccttagctggcgtttacgccgctttcgctgaaaatggtgattcactcaaccaagcgcaagtgactgctgctcaagacgaaatgagcaccctcagcgatatcacacaggctaataaaggcaccgatggttattcagactcccaattaaataatgccgttacaggtgccaaaaaagacatggcaagtaaaggcaataatctgactgttaaccaaattactaccatcgtcaataatcaactcgaacaaaacaacctcaccaacatcatcaacaataatcaaaaacaacaaatcattaatgttctcgtcaaaattcaagattccggtgctttaaattcggatgatttcaagaatcaagccggtaagttaatgaataatatccaaagtggtgcaaaaaacatcttcaataggctcaacacccaaagcaatcggaacttcattcaaaaactctttgatagcatggctaatttcttcaaaggattatttaactaaataacacaaaaaagccccgcaaactgaagtttgcggggctttttatttattcattatttcgttgttgcttttaaggcaactgcgtctgcagcaactgtggtactcattgcgttaaacttaatgtaatcaacagcgggcatgttggtaatgatcaccatcattgccgtcttcttaccagcagcagtaatttgattcaaatcaaccgttgctaataagtcgccatgtttgattgtttggccttcttcaacagcgactgcaaaaggtgcgccgtttaattcaaccgtatcaattcccatgtgcactaagacttctaaaccgttcgttgttttaatcccgattgcatgtttcgttgggaacacagtcataacagtcccatcaactggtgcaacaattttgccgtctgttggaatgacagcatagccatcaccgagcattttttgagcaaaagttggatcatcaacattttcaatatcgatcaattcaccattagcaactgcatagaaaacatctgtttcacctgagttaatatcgctatcaacaggtgcttcaactggtgcggcagcttgttctggtgtacttgttgcgattggcgtattgtggttataaagttcttttaaagcatcagcaacaaattggacttctgtcccaataataatttgaatgtttgttttatctaaaacgttaatcccagcagtaccagcagctttaatcgctgattggttaacattggcagtgtcttctaattgtaatcgaagacgtgttgtacagttgtcaatcactttgatattgtctttgccaccgattgcagcgtagatccgttttgcttgaaccatgaatttatcatcagtagcgtctgtttcaacgccagcagtatcttcatcaacagcatcttctgcttcacgacctggtgtcatcaagttaaatttcttgatggcaaagttgaacccaaagtagtaaataactgccatgaccaacccttcaaccaataacatcaacggttggttagcaactgggtttttcaaacttaaaacataatcgactaatccagcactaaatgcgaaaccggctgtccagtggaagaaagcagcaacagccaatgaaatccctgtgaaagctgcatgcaatacataaagtggccatgcaacaaacatgaatgagaattcaagtggttctgtcacccctgtaaagaatgacgcaaaaccagcagctaacatcaatgaagctgttgctttacggcgttctggacgagcatttttgtagattgcgtaagccccagcaggtaagccgaacatcatgactgggaagaaaccagcttgatacatccctgtcttaccaatcacagctgaaccattcgcaagtgatttcgcaccacccaagaaattcccgatatcattaatgttagcaacatcaaaccagaacacagagttcaaggcatggtgtaatccggttggaattaataaacggttgaaaaagccgtatagaccggcaccaaaccaacccaatttagaaattgcttcaccaaatgacactaatactgtaaagacggctggccaaacaaagtacaagatagctgaaacaaccatcattgcagttgccgccataattggcactaaacgtttcccactaaagaatgagagggccattggcaacttcacgttgtggaagcgattatacattgcagccgcaattaagccggcaataatcccgattaaaacattcccttcaatcttaccaaaagctgggtttactttagcgatgtctgataaaccttgcatcgcttgaattgaagcaggtgccaagattgtcttaggcactaagaaagcgactaaaccagcaagtgcagctgcaccatcttgatccttagacatcccgagtgctaaaccaacggcgaataataatggcaagttatttaaaattgcaccgccaccggctgataagaaaattgtaaagacgtttgcgtttgaatcgccattgccaacccagttcgcaatccccattaaaattgcggctgctggtaaaacagcaactggcaacattaatgaacgacccattcgttgtaagtaattcttcataagtttttctccattcatttttttcgttaatatgattaaatcattaatgtaaacgataagcaagcgcttaacaatcggtatagacctttataaatagcggttgaagcggtttcatgcacacaaaaatattggtctatacctaaaagttaataaatgatatctgattcaccaaataaaacggttgcattcacctaccacactctctatactgagggtacaaattaatcgctttgcactaggggtgttcttagaagaactgagataggtttgtacagcctgatccctttgaacctgtaagttcagacttgcgtaggaaagtgcctttctttagactactcacaccacttttctatgcattcgtgcatcgttaagtgatttttttagtttttaagggaggtttttatatggttgtttcactgttagaaaaagttagagcgctcaatccaatcgttgctaatgtcgcaaatggcatcgacgccgggcatggaaatagcgatccagtcattattgctaaggccgcggccaatcgtttacacaccataattttattaacgggtccgaccgacattattacagacggtcaacgcgttacgctgatttcaaatggtacctcactttttcaaacacatgttggttcaggtgatatgttatcgggtctctgtggtgcatttgttgcagttcatcctgtagatccctaccaagccgctatcgaagcagccgccacatttgccgttgccggcgaactagtagccacagcaatggaaacaccgctacctgggaccttctatccccaattaatcgattatttattccacattaccccaaccaaagtagcaaataccgtccaactaagttgaggtgcctactcatgaatgaattcccacaagctctaaccatcgccggttctgacagcggtggtggtgctggtatgcaagctgatattaaaactatccaagagcgccatgtttttgcaaccaatgtagttgtcgcgatcaccgctcagaatacgcttggcgttcaagccagtctgccactaccactatcactaatcaatcaacaattcgcttcattggctactgactttaaaattcgtgcctgcaaaacgggaatgttggcagatgctgaacatgttgcaacggtcgctgaaaatctacgccattatgattgggggccgctcacccttgatcctgtaatgattgccaagggcggtgcacagctacttgccgacgatgccatcgataccctacgtactgaattattgccgctagccacagtgctgacacccaacttacccgaaaccgaagttctcacgggcagccgcataaagacaacagctgatttcaaacaagcggcccaccaactccaacaaatgggcgccaagaatatcattatcaaagggggccatttagactatcaatcacaagccgccgattacgtcctctacgctgatggacaagatgaatggttaactacaccacgaattgctactaaacgaacacatggcactggagatacgttttcagcttgtttaaccgccgagctagctaagggcacccctttgaaagcagcaattcatattagcaaagcctttatccaagccgcaattgctaatccgattgctgttggtcacggccacggaccaaccaatcactgggcttatcaggaggttcatcatgactaacatttcccggaaaatgttccaaacttatttggtagcgggtacccaaaataccggtatggatgattttctaaacattctcgaacaagcactacaagccagcattacctgtttccaattccgtgaaaaaggtgctggtagtctgcaagattccgatgcgattttaaagtatgcgacagcggctcaagccctttgccgccattatcaagtcccatttattatcgatgacaatctcgatttagcacttcaaatcaatgcagatggtattcatgtcggccaaagcgatcacccgtggcataaaattgaaacggccaaagcacacggcttaataactggtctatcttgccacactgaacaagaacttcaccaaagtcataatcaaccgatacttgattacattggcattggtccaatttttccaaccaattccaaagaagatgctaaaccagcacttggcactaatcgcttgcgtttcttaacgcagcaaagtgaactaccggttgttgcgattggtggtatcaaccaagaaaacgttgctcaagtcgcaaagactaccgtggatggagttgccgttatctcagcaatcacccacgccacagatatcgctcaagccgtccaagcattacaaaagccatggcaccgcagtactgatgaaaaccaatcgtaattaacccttattacggtttgacccattctgaatagtatttgctgccagtttgatccaccaaacatttaaaaaagccgctagaaccctttttatagagtactagcggctttttctcggtagtttgctgatatttagcttagtgctttgttagtgatgactactccatttaacactactcggtaaacttattcattagcaagggcttcaaaataacttgctttttgctgcgcccagtaggcctcttctgcctcatcaatcggccggagtacccgacatggattaccaactgcaatcacgttatcaggaatgtctttagtcacaactgatccagaaccaattaccacattgttcccaattgtcacgcctggattaacaaccgtattgccaccaatccacacatcatccccgatggtgattggcttaccatattccaaatcatcccggcgttcttgtgccgtcgttgggtgaccagctgtgtagagtcctacacgaggtccaaagaaaacgtggttcccaatcgtcactggtgctacatcaataatgatgcaatcgtaattcatatacacatgctcaccaatgcgtgtttggcaaccataatcagttctaaatggtggctcaatatataaatctgagccacttttcgcaaataaagacttggttaattcgcgtcggtaatcttgttgttcttcagtagtttgattaaacaaccgagtaagtacgcgcgcgtgtttcatatcggctcgcaattctgaatcgttcgcccgataaatttgaccattaatcgtgcgttttttttctgacatttctttatcccccatcactactaaaaaaggtgcgtcacaattgtggcgcacctttttaatttaccaaattgcaacccgtttagcgggtgctaagtacatctgatcagctttcgttacattaaatgtctcgtaaaaggctgccaagttttggacctgaatattggcccgcaacgcgtttggtgcatgaacatcaatatttaacaataattgttgatattgctttgtagctttcatccgccaaatcgttgcccaattgacaaagaaggctgccaaatcaacatcaggttcttctttggctgcttcaagggcacaactcaagccacccgcatcggcaatgttttccgagacagttaatttcccgttaactgttgcgcctgcatattctaggccatcaaattctgcaatcatttcttccgaaagtgtcttgaagtgagctaaatctgattcttgccaccaattatgcatgttgccatactcgtcgaattgcgcaccgttattatcaaaagcatgtgagatttcatgtgcaatcactgcaccaatcccaccgtagttagcactgctactttgttctaaactgtaaaaaggtgcttgcaaaatagccgcgggaaagacaatgacattcttcgaaggtgaataataggcattaaccgtggcagcgcccatttcccacttattacgatccaccggttgagtaagtttcgcaaaattttccgtttcaatcgttcgaataaagtcagctgtattttcaaataatgtcccatcttctgctttaggtactgtgaccaacttcgcgaaaataggggcaatctgatccgggtaaccgacatgaatcccaaggtggttgagttttacaatcgcttgttggcgtgttttttcggttagccagtcatttttctcaaggcgtttttgataaacaccaatcattttttggaccatcttttggacgtcggccttggctgcttcaccgaagtattgccgaccgtaataatcgccaacaacttgattgaacatccctaaggcaaggtagtaagcactcttttgttgtggacgagcttccttgctaccagataacgcacgactatagagcgaactaatttggcgtgcctcttcattcagataaccgctccaactacgaactgtcatgactaacagccacgctttgaacgtttcgaaattggcgtctgtcacaagctgattcagttgcgcaaaatacttcggttccgtcacgataatttttttcggttgaacaggtagcaccttgctaaataaacgtggaaaatcaagcgtcgtttgttgttgcataaaatcactcaaaggctgtggattatagagtttcgtgtaatccgctgcttcttcggcactcttcacataaggtgccagtgaccgatcaaatgccaacgctaatttaaccgtcttcgttgcatcaacgggcgcaatcccaattttctgcaagagctgaaccatcatatccgtaaagaccgccaataaatggtcagcattgggattgtcagcttcataataggtcttatctggcaaaattaagtcgctagcttccgcatacaaggcgtgatgggctgtgtctttcatgtcagcatcgacagataagccaaatggtgttggtaacccggaaagtacccaatcagctaacccacgattgtaagttgctaaactatcgagagattgcacccgggctactattggtagaatcggtttcataccgagtgcatcacgcgtttgaaagtccgcagctagttcgtaataatctagaaaatgttgtaacaatgcgttctttgcggtcgacatcttagcaaaatcagccattaattgctgatcaatctcatcaaccaaggcgacaaagccgcctgttgctggtttatccgctggaatttcagccgtttttaaccattcttgattcactgccgtataaaaatcatcttgcattcgcacgtttgtcatcattgtcctcctcaaaagcagattctttcccaattttaacattttaccactttttccgttaatgctttgacccccataattgtaaaaaagccgcaatttagcggctatttcgttggtaattgtttttcaacttaataatttgaatcttggttaagtttaaacgtcttcttcaaaccgtttgatagatagattttattatcttttgtgatcatgacggcttggatattcttcggtttgttgttgatgagctgcatgccttcgacaatccccttattaaagacagcatttgaaagggcatctccatctactgatttaggcgagataattgtgacactcgctaggttattttcatatgggtaaccagtatggcgatcaaagagataaatatacgtatgaccatctttttttagataatgttcataaatccccgccgtaacaaccgaaatatcacggcctttaatcgtaccgactgattctccacgcgcctttttcggatcttgaatgccgaccgtccatggtttgttcttccctaatggtgaatgccccataacaatcacattcccacctaaatcaataacggctgatgtcacaccattttccttaaaaacttgtttaacttgatcggcaatgtaccccttagcaatcccgccaaaatcaagtcgcatgccttttttcttaaggtaaactgtacgtttggccttattcaaaacaacgtcatgataatcgactaatggtaacgcttggtcaatttctgcttgtgctggcacccgcgcgcctggtaacccaatttgccataaatctgtgatcgcaccaatggccatatcaaacgcgccatccgattcttgactataatgtaacgctttttccattagtggccacatatctttgctaacctgtacaggtttaacaccggcattatcattaatcttatccaattcggaacctgatttggttaacgttgcttgattttcggactttttaatccgcgaaaaagccttatctagcacggcttccttgtctttattatagattcgcaatgtacaaatcgttccgagatagtaatcacttttttcatagggctttttgaccaacgtttctttgtccgctggcttactttgacagcctgccaataccagtgtcacccctaagagtgccaatccgaattttacccatcgtttttgcatcgttcaatcgctctccttgctactaaaatcacatggctctatcataccatcaatccgctttaattagttgtaaaaatcttctactggcgcgattctttgagttgctgataggtggcaattaatgctttaaaaacacctttatccgaataaactagaatattcatgcgatagataattaatgctaaataagtcagtccaattagtgtcgccatggctatgaagagtcccatgctagccccgaacgcgccaacatcaccgtttgccagccgcacaggtaacataatctgtgaaaacaatggcacatagctcaccgcccgcaataatggaatatcggtctgtgatgccagtacaaagccacccaaataacttaatgtgcccagtaaaatcaatggcgaaatggcttgttgtacctgatccattcgagacacaacagcgcctaacattgcagctaatacggtgtagagtaataccccaataattaaaaagactcctgcataccacattgctggcgcaaccaaagcacgacgaataatcggcaataactctgctaacggtagttgctgtttcaaaaactgaaacccgacaatcccaactaaaatatagacagtaatttgggtgagtaatagggctaatatcgcggcaatcttcgcgaaaaattgaatttcaatcgaaacacttgatagaatgatttccatgattcgcgaccctttttcagtcgcaatttcttgggcaatcattccagcataattcacgataaagatgaacattaagaccgtaattccaattgaaataatttggcccacttctttagtgttttcctgggaaatcttttcatgaccattctggtaattaaccgtcactggtgcaatgacagttggcgtcatcaatttctggatctgttcaggtgcaacgcctgcttgttgcgccaaagctactaaatgaatctgatttaactgattctctaagacactcgcatcaaatgatggactatcttttcgttcatagtagcgactgattgtctgtcctttttcctcactcaacaacaaatagccatcaattcgctctttctggagcgctttggtggcttgttcccgagtcgtaatctgctgatcgatttgatatgttttaccttttaactgctgtaattcactctgttctgctggttgcggcgccaaaacagcaattctaacgggttctttgctatgatccatcaagtgactcacaccaaacgtaatcccgaacatcacaattggcattaaaatcatgattagatacgctggacttttaatattctttagaaatacttgtttaaaaatcaccttaaacttaaacatggccttcctccactttcattctaaagatttcatcgagcgttggtgcttgttgactaaactctaggatatagccattttgtgtcgctaagtcgaaaatcgttttaccaaccgtttcgtctgccaaagttaattcaaaccgctgcccgtgctgtgttacacgtgaaacaccgttgatatttgctaaagtttcgcgtgctaacggtgcctctaagaataattgcgttcggccaaactgattccgaatttcatcgattgtaccggcgagcaccacttgcccatcgcgcaacatcacaattcggtcactaatccgcgcaacattcgtcatatcatgactcgaaaaaatgattgctgaaccttgttctttaagccataaaataccttcttctaatagttctgcattcactggatcgagtccactaaagggttcatcaagaataatgagttccggttgatggatcaaagtcgcaatcaactgcactttttgttgatttccctttgaaagatccttgattttatcagtccgcttacctttcaccccgaagcgcaccaaccactcatcaatctgtggtttgatgtctgcgatgctgcgcccacgaagctgggcaaagtacaaaatttgttgttccacggtcatctttggatacaatcctcgttcttctggcaaatagccaagttggtcataatccgcagcggtaaacgcgcgacctttccagagaatagttcccgtatctggtgccataaaattcaaaatcatccgaaaggtcgttgtctttccagctccattttgaccaattaagcctaatatttcgcccgacttaaccgtaaatgaaacatcgtcgaccgctagcatcgttccgaaacttttggataaatgtgataaagtcagcacgtccccaaccccctacttttcattaccttaactataccgtattcatttagaaagcgcattatctctcaatgaaatattaaaattactgattaaatcttaatagttgaaaaatatttgctatactacaattatttattaattaggaggtattattttgtccccaaatcaagccttttttctcactgttattggttgcctgttagctatcagttcatcttattttatcgtgcgtctcaatatgctaaagccaacacttaagcaaaatttcttggaccaatatcctgacacggatgaccaagcttacaaagcgcaacaatcaatgaaacaagcttatttcaacgcatccttttacaagcaagctgttcctttaacatcttggttagtccttttattctttttatcaatcggtggctgtctaacagcgctctatctagatgccctgaacattgcaatccgtcttttggggagtgcattcatttttatcgcgtttctctaccttaagttgccgacttttcaagcacagcatactttttggaaatcttatctacaagcgcatcctgaaaatgaattaaaagtcgtcatactcccactcgattcacccattcaacagcggcggattgccttactcaccaaatttaaatgttgtactcttgtagcaggtctcatattgttttacgcctctctttttctataactcaaaaagcggcaccaaccattttatggttggtgccgcttttttaattaacgaatttcaattgggttcgttggttggtctgattcacttaacttcggtaacattaattgtaagacgccatcttgatattgcgcatcgatttgatcccggttgacaccaggtaggtagaattgccggctaaagcgcccataatgccgttcgctttgaacgatattgccttgactgtcactatgatcagcgaaactatcacgtttagcactaatcttcaatgtattatcttgataatccacgtgaatatctttcttgtccagtcctggtaaatcaaccgctaattggtaatccttatcggtctctttaacatctgttttgagtaagttgtccgtttcaggcgatattgccaataattgctgaccgaaattcttgaaccaatcatctccaccaaaattatctagccaattttgacgaccattcattaattcgtttgccatctctaaaacttcctttcttaatctttacaactctattctagtccgttaattatgaaatgcaagtaattagcactcgacgttgttgagtgccaatttttaaactagaccactgatttttcagcttttgatacccgcctaatatggttttgtgctatacttaaggttccaaaaatattcggaggtaggttcatatgaaaattgttgtcttagcgggcgggcgtagtaccgaacgtaacgtttcattaacgtctggacacaaaattaccaatgcattacaaacgaaaggccatgacgttgctttcgttgatcttttcttaggaaatgatttgcacgacgtcgcatcaatcgatgatctttattcttcaacacctgttgaaaaagattacgacatcagcgacgaagttttaacagacgacgccatcaacgcattacgtactgatggttcaacacaactctttggcccgaatgtcttagagatttgtaaaactgctgatattgtcttcctcgcacttcatggtagcgatggtgaagacggtaaagtccaagcggttctcgatctctttggaattccttataccggtagtgacacactcgcagcaggtattacaatgagtaaaaaggtttcaaaggaaatcttattatataaccaaattccaactgctcggtttgtcgctgtttatcgcgaccaacccatgccagaaatcccatttgagtaccctgtcgtggtaaaaccaagtaacggtggctcaagtgttgggacgcatatcgtgcacaacgaagctgagttacaaccagctgtcgaagatgcacttcgtttcgaccgcgaagctttaatcgaagaattcattaaaggccgcgaattctcacttggcgtgattaatggtcaaccattacctgccattgaaatcgtcgttaatgacggttggtatgactttgagcacaaattcgtgactggaaataccactcaatttgtcacaccaccaaacgatttacctgatgatgtgcacgaagccatgaaacaaatggcacttgatgctatgcaagcacttggcttaacgaactacgcccgcatcgacttcttctggagtcctgaaaatggcttacacgtgatcgaaggaaatacattacctgggatgacgccactttcattaattccacaagaagcagaagtgcttggtatcagttatcctgatctttgcgaaatgattgttcaaggtaaattagaactccttaaagcaaaatagccaataaaaataaccctgtcgacgattttcagtcgacagggttatttttatttggttcatttaaaactgattacgtagttcctgattaggaactattctttaaaaaacacgtcgattggaattcccaagcggtcatgtagtaattgaatttctttgacggtaaatggaatcttccctctaatcttacgattagccgtcgttaatgttttgcccaatacatcagcaacaacttgctgtttcaaatcatgactctttaaataacctgatagaacaaataatttttctgccacattcagcaccctcaagaaacgttatcaatcccgttccacattaggaatattaagataatgtaagaactttgtcaattaaaaactttagtcccaagtgttcacttattgacgtcatttgtcatataattaaacttataagtcaaacgcgtgataaaggacggtgctaaatgttcggacaattactacacgataagcgaactgctaagaatctaacaatgcaacagctcgccgatctactcagcgcaaaatataataccaagattagtagctcaatgatcttccggcgggaaaaaggcgctgccccatcactaaaagcattatttattgttgctatcgaattgcaaatcgatcttaaccaattggccacccttgttgcggatcctaaccgcgtcaattagccgcttttttttgttttttacccgatttttgaatggtcttcacacctagtacatctaaaaagaacgtaaagattggtaatccaacaattaacccccaagttcctaagaaacgttctgctacaaataaaacaacaaatgtaaagaaaattggcagctgtgttttactcgacatacatcgcggattcaaaacatatgcttctagggcatgaatgactaaaatcatcaccaatatataaaccacatactgaattccgccgactgaaaaggcgataatgcacaatgggatacatgaaacgatgactcctgcgaccggtaccatcgacaataggaaaatcatgatggctaaactcggaatattaggcatgttcattaccgttaacgtaatcgttgttaacactgtattcacaattgcaatgaagatttgggcttcaattaccacgccaaaggtattcacgaattttttagcaaaatacatgatatcttggaagaaccagccgtaagtactcttcaaaaagagttttccaaactgcggtaatcggtctagctcaattgtgtaaaagaaactcaaaataaacgataagacaattgtgacgcccattgttccgattccggtgatgtaattaacgattgttgatacaccgtgtttcaactgatccgtcaagttgaactgtttcatgtaatccccaatggttcgcataaattgattcgcatcaaatgatggactttggtagaaattatagacactctcgcctaatttaattgactgtttagcaatctgtggcacataaatcgttactgctagatacactaaaaaaatcaccaacatataaagcggcacaaccacagctgcgggcggaatttttgaatactgttggacctttcgtactaattgagtcactaaaaaagtaaagatgaacgtcagcaaaatgatattcatcatcgagcgtgacacatagatgaccccaatcaacgttaagagcactacaactcgtcttaactgctgattcgtcacaaatttttgatataaactcacgcaatttcctcctatggcaattctatatcattattttacaacacttcgaactaattggatattctggaattccgatagttgcgacttacatctttttaaaaatagtcgtatactactctggtacttcaaatttacacctagaaaggattttcggtatgttagaaaaaactttttataagaaactactacaacactcttttgatttccctgttaccgtcaactattgggacggcagctccgaaacctatggttctggagagcctgaagtagcgattacttttaaaaaagcgattcccatcaaacaattgtccagcaacgcatcattagccctcggcgaagcgtacatggctggcgaccttgaagtgacaagtgatacaacagataccccacttcaaaaactattaacggcggcttacactagcgcagacagtttcatgcgtaatagtcgctacattcatctgattccaaaacaatcgcattcagaaaaggcaagtaaaaaagatatccaaagtcattacgatttagggaatgacttctaccaactttggttggataaaacaatgacttactcatgtgcttattttgaaaaaccaactgatgatttagagacagcacaaattaataaagtgcaccatattttacgcaagctcaatccgcaacctaaccgaacattgctcgacatcggctgtggttggggcaccctcatgttaaccgctgctaaagaatatcatctcaaagtggtcgggattaccttgagtcaggaacaatatgatttcgttcaacaacggattaatgacgagggccttagcgatgttgctagcgtccaacttgttgactatcgcgaactcaaacacgccccattcgattacattaccagtgttgggatgtttgaacacgttggtgaagaaaatcttggtgcctacttccaagatatcgctgactacctcactgatgatggggttgccctccttcatgggattacccgtcaacaaggcggtgcgcgcaatgcctggattaataagtatattttcccaggtggctatgtacccggtttagttgaaaatacacaacacattatcaatgccggactacaaattgccgacatggaacccctccggcgccattatcaaaaaacgctggaaatctggactgctaattttaacgcccaaaaagacgtcattttaccaaaagcaggtccagaattcgtccgcatgtgggatctctatctccaagcatgtgcctcatcgtttgaatctgggaacattgatgtcattcaatacctcgtatcaaaaggccccagcgcaagagacctcccaatgacaagagaatatatgtatgattagagtgctgactgtcgcgcttagtcattgagcattaattcaaaaataacataaatccaggttttgggatttatgttatttttagattaagcggaaattactgcgacaggaagcacgtttagagtgctgagtcgaacgggttggctttgaggattaacaaaaaacgggtattatggcgatttttcagccataatgcccgtttttaggttaaccggaaaaggcagctcgaggaagcacgtttcaaatcaaagtacctgattctgcgggaaagatatggcagatgaaacccgttttcgttagcgtgccgactcaaacgggttggctttgaggattacccaaaaaagacccgctaatcagcgttgattagcagtcaatataaaaacccccgatattggattttggtccaatatcgggggttcacttcaacggttcttttttagttatttgaaatagtcggttaagccggtataaacggcatcagcgactttagcttggtaattagcactgctaatataactaaagtctttatcagaattgatgtagccgagttctaagagaacagcaggccgttgattatcgcgaaggacttgataattgccgtattcaatgccgcgattgttaagcggtaatgtcttagtctgattgttgatggccttcgcgaggctcatatccttactgcttgaatagtagtaggttgttgtcccggatgcttcattggcttcattgcttgaatcaaaatgaacgctgataaaggcatcagcctttaatttattggcaagagcaggtcgcggttcgagatcgacaaaactatcatttgaacgcgttagcacgacgttagcaccagccgcttttaattttttagcaatcgcatcgacggtcgctaatgtgtagtctttttcatacttagacttagttgaaagtgcaccgacgtcggtgccaccatgaccagcatctaaaacaatggtggcttcagaaagggaagtagcgctagtcttaacaacttcattcttctcagaaggagtgacaacccaacttgcgacgtaaccggtattaccatcggcatctttaacttgataccaagtaccactcttattgatataagttagcttggtattggccgggtagctttgggtatattgatacgaaacatcaggaccagtgcgtagcttggtattatccagttgggtggtcactgatttaatcgcggagctacttgtatcagtatccgtagactcagattcagcggttgtcgttttttgaacagtcgccggagcttggtcggaaacttcgattaaatcactttgtacccaaccaactgctgagttgtatttaatctggctccaaccgttttgttggtataagactgtaatttcgtcaccttgatttaacttaccgagtagttgactatcggcactactgctttggcggacattggcaaaactgttggtgaccttagcgactcggtttgaagtggcactgacttcggtgttatcgactaaccagctagcaacccagccaatcttatcaccacttaagcgcacttggtaccaattattcttttgtgagataacattcattgtttcgcctttattggcttgactcatgacatcataagataatccagggccttggcgaacgtttacgacgttcgctttaatcgtaatttgttggtaagcagccagcgcgtgggtcacaaagagaccgacaaaaacgagtaatgctaatataataacggccggatagtgtttaaaccagctcaaaggtttctgcatttttttcaacacctttgttatgttttattaatttataaggttaattatagcaaaaaactcaactttctaaagagtttcagcgaaaaagttacaaaaaattcaagattgattgacttttttttgaaataacgttaatcttataacaataagaataagtgatgaccagtgataaagtaaaggctaagccccctacgacagagatgatttcacagctgcaagaaatcaatggcacgccgagactgcttttgaggtctgtgtggtcgcacaccgttggcaacaacgttatataattaagctaaaattaaggtggtaccgtgcatttaagcacccttgttcaacgacaggggtgtttttttatttggtatccatttggaggaatgatcatgggctatcaaaagccaaaaggaactgcggatattttacctggagattcaaaccagtggcaattagtggagaaaacggcacgcgacgtttttgcccgctatcaattcaacgaaattagaacaccattatttgaaagctatgatgtcttttcacggagttcaggcgatacatctgatattgtcagcaaagaaatgtatgatttcatggataaaggggatcggcatatcgcgctgcgtccagagggcacagctggagttgtacgggcgttcgtagaaaataaactttatgggccagaacatcaaaaaccttataaggtgtattacatgggaccaatgttccgttatgaacggccacaatcaggccggcaacgccagttccatcaaattggggtcgaagcatttggttctgagaatccagcggtcgatattgaagtcattagcatggcgatgcgtttattacgtgaatgccatattacggatttaaaactggccatcaataccttaggggatgcggaaagtcgcgcggcttatcatgaagcccttgtcagctatcttgaaccacattttgatgaattaagtgacgattctaaagttcgtctacacaagaacccattgcgcgtcttagatagtaaagatgctaaggaccaagaaattgtgaaggatgcacctgttattttggattacttaacaccagaagcaacggcgcactttgaaacggttaagcacttacttgaaacattgcacattccatatgaagtggatactgaaatggtgcgcggactcgattattacaatcacacaatttttgaaattatgacaaataataaggtgcttggtcgcggctacacaaccgtcttagccggtggccgttataatgggttagttgaacaacttggtggcccggacatgccaggggttggttttggcttaggcgttgaacgattattattattgatgaatgcgcaaaacgaagcgttggttccagaatctaaactcgatgtgtatgtcgttggaattggcgctgaaacaagtgcgacaactctccaaatcgttgaaaagattcgtgatacaggtttaaccgctgatcgagactatcttgatcgtaaaccaaaagcgcaatttaaaacagctaataagttaaacgcccaaatggtgattacaatcggtgaatcagaattagctgatcaaacagcacatgttaaagacatgattagtggtgttgaaattacggtaccacttgctgaagtctatgctgactttaaagcagtgcaacaacagttaaatcaaaattaacgcatataagatgcctcaaaagtaaatttgaggcatcttttttatttgatggcagtcaattcactttaatcctcaggaaatcccagactgtcagaacactctgagcatatttgtcgctatctgtttgtatctgcttataataataaacacgaaggagtgatggatatgacagatgatttagaacaacggttaacgacggaacaatatgcggtaacccaacaaaatgcgacggaggccccatttaccggcgagtatgatgattttgatgaacaaggcatctacgtggatgttgtcagtcatgaaccattatttagttcgttagataaatatgatgcaggctgtggttggccctcatttacaaagccaattgcgcctttgacggaacgccgggaccaatcttatgggatggaacgcgttgaagtccgtagtgaagaagctaattcgcatttagggcacgtttttaatgatggaccgcaagaagctggtggattacgctattgcatcaactcagcagctttaaaatttattccagtcgaacaactcgaaaatgaaggttacggtcaatatctaagcttatttgaagagggggcacaataatggcaactgatacagcaatttttgccggtgggtgtttttggtgcatggttcatccgtttgatcagcaaccggggattatcaaggttgtttctggttataccggtgggcatgttcctaatccaacttatgaggaagtttgctcgcatacgacggggcacactgaagcagttgaaattacatttgatcccgcgattatttcttatgcggaattagttgaaatttattggcgccaaacagatccaaccgatgccatggggcagttccaagatcgtggcgatagttaccggccggtgattttcgttaactcgcctgagcaacgtgcaatcgcggaagcttccaaacaagcattaatcgatagtggtcgcttcaacgaaccgattgtcacgcaaattgaggctgccaaaccgttctatccagccgaagaatatcaccaagatttctataaaaaagaaccatttagagcagaattggtcgaggggacacgccgtgctttcattcgtgaaaattgggcgcattaattccaagaaatcctttagtattcacaaatggtatgctagaatgaaagacatcaaaagtgaataggtgtgatattcaagtggacgatttagctcggaaacatcaaaatatggcgaagatttcggcagccattttatacggaatttgtgtgtcgattgcattgaactttttctgggaagaaggtggcatttacgcctctgggattaccgggttcgcgcaattcattcatacagtgacgtcgaaatttatgccgtttctaccatttccattatcaacgtcattgatgttattcgtgttaaatgtgccattatttattcttgcgtggttcaaaattggccaccatttcaccatttatacgtttattgcagttgttttttcaagtgttatggtacagattatgccctttacacagctaaccactaatccgattatctgtgcgatttttggggcggtaattaacggttttgggaccgggatggccttgaaaaacgatatttccactggtggcttagacatcattgggattgtactgcgcaaaaaaaccggccgttcagtcggttcaatcaatatcatgtttaatgtggcgctcgtttttgccgctgggttcctctttggttgggaacatgcgctctatagtatcttgagtatttttgtcaacggcaaagtcatcgatatggtttatacgcgccaacaaaaactgcaggtgatgattattaccgataagcccaaagttgtgattcaaatgattcaagacgaaatgcggcgtgggattacgattgtccacgacgtagaaggggcatataaccgtgaagaaaagacgatgttatttaccgttatttctcgctttgaaatgcatgatttagaaatggtcatgaaacaagcggatgatcacgcgttcgtcagcatgacggaagctgtcaaaattctcgggcatttctatgaacctaagattaaataagataacccgccattcagttgaatggcgggctttttttatgggttaggtttcgtcttgctttttgttgcgctttctgtgacaatctagttaatcaaaatgcatggaggtagtggaatgttattagggagtcacgttagtatgaaaggcaagcagatgttactaggatcagcagagagtgcagttgattttggtgcaaatgccttcatgatatataccggcgcgccacaaaatacgcgccgcaaaccaatcgaagaattaaatattgaagcagcaaaaccctatattgaagctcacaacttaggtccaattgttgttcatgcaccatacatcgttaatttagggaatacagtgaagcctgagaacttcaagtttgcggtctcttttttacaagaagaagtgttacgcgctgaagcattaggggccactcaaatcgtcttgcatccaggtgcacacgttggggcgggtgcagatgctggtattcaacaaattatcaaaggattaaacgaaattttacgatctgatcaaaccgcccaaattgccttagaaaccatggcaggtaaaggaaccgaagtcgggcggtcatttgaagaacttgcacagatgatcgatggcgtgacttacaatgaaaagttatcagtgacgtttgatacttgtcatacaaatgatgccggatataatgtgcgtgaagattttgacggcgttttgaatgaattcgatcacattatcggtttggaccgcttaaaagttgttcatttaaacgattctaagaacccacaaggcgcacacaaagatcgtcatgccaatattggttttggtgaaatcggatttgatgcgctaaaccatgtcttacagcatgaacaactcgttaatgtgcctaaaattctagaaaccccatatgttggcgaagataagaagcataactttgcaccatatgcgtatgaaattgcgatgctcaaagcggggcaattcgaccctgatttattaacgaaggttgagcagaacgaaggcaaactatgaatttaaaacgaactaagtttggtatttttatcttaatagcggcgttttggacctttatttttagccagccagtccaggctgccgatacctatgacatcagtcgttatcaggtaaacgttgatgtacaacctgatgggagtgctcaggtcgaacaaaaaacggtgtttgatatccaagatgatatccatggggtctatatcaaccagaatctccaaacaaacgttggtcaaccaaagaagttggttaacccgcaagtcgcagttaatggtcatccgtttagtcaaagtgaatcaggtactgaaggcacctatagcttaactgatgcacaacaaaattatcggttcaaactataccaaactgcacaagatggcaatcaattagcggttactttgaaatatcagttacaaaatctgattattaattatcgtgatacggcggaattgaattggaaagtgattggcgatgcgtgggatagtgacttacaaaacgttcaagtggtaatacaattacctaccacattcaaaaaagcagacctcaaatcatggacgcacggcaatttagatgggcaacaagtcgttgaacccgataaaggccgggtaacaattaaactcgctaataatccagcaaaccaatttgtcgaaagccatattatttttccaacggcggtgactgcggcgaatccgaatcagattgatcaatcacgtcgggcagccattatcaaacaagaagcgcgtttggcgcaacaagctaatcaagaacgcaaagcacaaaaacgccgttattggcttttatctataggagcagtggtcttagcgcccggcatgttcttgttaattttacgtaaaattcgaaaaacgcttcctgtgatgacttatactggacaggcaccagaacacgtctatgatttaccagatgaaaatgggcctgcggttgtgcgtcagttgttggcattaccaattacggagacagcaggggcggagagcttatccgcaacgattctagacttagttgctcgaaagaatctaacaattgatgttcaggaaccaaagaaggaactattccataaaaaaacgccgcaattttcattaacgctcgtcaatcgcaatcagttatcacattcagaaaagaagttagttagctggctatttgatgtgattggtgatgggcagcatgtcagtctatttgagattgagaaatatccaaaacggcatagtacaaaactgttcaatcaacattaccatgggtggcaaacagcagtggcgactgaagcaagtcgtagcgggtggttacgagaacacatcgctgagttaatgaccagtttgaattattggttaatcggccttggcgccctatttttaattttgatttttggtgctttgattggcttagttgcttggtggacgctcattccgatggggcttgtcttcattttaaccgtctggcgtagatttaatttgcaactatggacgcaattgggttacgaaaaacggggcgaatggcaaggctttaaacaaatgctaaaggatatttcgacactcgatatggcgaatgtcccagatgtactattgtgggatcgatatttgagttatgcaacggccttcgggattgctgataaggtcgttaaagctttgaagattcgattgacgccggaacaacttcaaacaatgcctctgggttattattattactacgggtatactggggggttgaacatcggtcaatcctttacaacagctctcaatagtagtgttggcagtgcggtcagtgctgctaatccaacaagtgttagtggtggttctggcggcttttcaggcggctcatcaggcggtttcggtggcggttccggtggtgggactttctagtccaatcaaatgattaggtgaaacgccaacacactggtattatgagcgttattaaaatgtaattaacgcgctaaataagtgttagttggaggaggaaagcacatggagtttaacgatgtggttaatcaccgcaaggcaattcggtcatttgacccaaacaaaccgatctcggatgaattaatcgaaaaaataatggtgtccgcccaacgaacaccgtcgtggacgaattcacaaccttggaaagtctatgtagcgacgggtgaaacgttagccgatcatttagaacgaacgggaaaccggatgaaaggctactctgatttaaacgtgattcaccggacagactggggaccgttaatggctgagaacagtcgcgtgtggaatgatgaaatcagtgcctatcttggcgaagacgggttagcgaattttagcgatttacaacgccatctgttcaacgcgcccgccgtgatttacttgacggttgagcgcaaagtttcgccatggatgatttatgacatgggggcttttagtcagtcgattctgttagccgcggctaacgaacaagttgatacaattcctgcctatgaaacggccaagtatccagatgcggtccgcaaagcaataggtattccggaaaatgaactgttgattggtgggattgccatggggtaccgtagtgaagggatgattaatgcgtttcattcgcagcgtagttcggttgcgagttttttaacgattaaacattaacaaattaaaaaagcgttcaaatcgatttcagatttgaacgctttttttaattgacgtgatcgttcgcactgcccgcaaaatcgaggcccatgcgttcaagaataattgtggcagtttcttcgatcgaacggttggcaacattaatcacttggcaaccaatcttatcatacaggtcttgggcgaaagccaattcagctttaatttcgtccatgtctgaataagtggtatcaggatttaacccataagcaatcatccgttcccggcgaatgttattgaggacttctggtgtattcatcaggccgataattttcttaggatcaacccgccagatttcgtctggaatgtgcgcttgtggcacgattggtaagttggcaaccttgatattccgattggctaaaaagagcgacagcggcgtcttagacgttctagaaacaccgagcaacacgatatctgcttctaagaaaccgtgggggtctttaccatcatcgtacataacagcaaattccatcgctgaaatgcggtcaaaataacgatcgttcaaatgatgtagtgccccagcttcaccagttggcgtgctgttggttttagcggtaatcatttgtgtcattggtgacatcatgtcgaaactggcaatttttttcgcttggcaataggtttcggcgatttcagaaagaccgttagtggctaatgtatggaccacaattgtttcttcaggaaccgctttgcttaagacgtccatgagtttctcttgcgtgtgaacgaaggggaagcggacgagatcaggtttaacgtccggaaattgggcgagcgctgcttgtgctaattggagggcggtttggccgactgagtccgaaagcacaaaaacggttaatggtttagattctggcataaggcatgctcctttattcacttttatagcgctatcataccataattatcgaaaaaatcgctagatttgaaaaaatattcaattaattccctgtgggttattgaccgtattttcaacattcgctataatagcaaagaacggttcacgtgaagttaaatttttaacgaacgtaaacggttatacttagcacgcgaggggagggatatcatatgggcaagacagtcgttcgcagtaacgaatctctagatgatgctcttcgtcgcttcaagcgttccgtatcaaaagctggtacaatacaagaatatcgtaaacgtgaattttacgagaaaccaagtgtaaaacgtaagttgaaatcagaagctgcaagaaaacgtaagaagttctaatttcttagataaaggaaatgattgaatgagtttacttgaacaactaagttctgatttgaaaacggcgatgaaggccaaagataagttgcgattagctgttattcggagtttaaagaccgctttaactaacgccaaaattagtgcggggcaagacttatcttctgacgaagaattaagtgtactatcatcacaacttaagcaacgtaaggattcattagctgagtttgaaaagggcgatcgtgcagatctcgctgaacaaacaaaagcagaaattgaaatcgtacaagcttatttaccagagcagctagatgaagcagcagtggtcaccattgttgacgaagcaatgcaggctactggtgcgacaagtaaggctgactttggcaaggtgatgcaatatgtcatgcctaaggtcaaaggacgagctgatggcgctatggtcaatcaagtcgttaaatcaaaattaagttaattttaggcgggacttcctctggggagtcccgcttttttttatggtcgttaattcagattttgataattgaccataaattcgtgaattagcgcggctggctacttttaaaacggttgttgtttgtgatagaatgatggtagttttcattctaaaacaaatgaagttgaaacgtgcggttgcaacttgattcttcactttacgacgtgtagttaataatcgactaaagtcgtttatttgctgggctagataatactcagaatcagttgcagtcacactctggaaggagttatctttgttggctgaaacagatgagcgtttatttcaattggcaacgccaaatttagcggccgctttaatgggcacacacgatacttttttaaaaatcatcgaggaaagcttatctgtcgaactgattgcgtttgacgagcatattaccattcgcggcgaacaaccagcagttgaccaagccgcttctgttttagaaaacttagtggcgctgttacaacatggcattaagctcaatagtagtgatgtggtgagtgcgacgaagatggcccaaaaaggcacgattgctggtttccaagaactttacacggagccattaatcaaggatcgtaaagggcagcatattcgcgtgaagacattcggtcaacgtcaatacgtgaatgcgattcgtcaaaacgatgtcacgtttgggattggccccgccggaacggggaaaacattcttagccgttgtcatggccgttgcggcgttgaaacaaggattagtcgaacggatcattttaacgcgtcctgcggttgaagctggtgagagtttaggctttttaccaggtgatctaaaggaaaaggtggacccttatttacgaccgatttatgatgcattgtatgccgttttgggtaaagaacatactgaacgtttgttagagcgtggtgtcattgagattgcaccgcttgcgtatatgcgtggccgaacactagaagaagctttcgttattttggacgaagcccagaatacaacgcctgctcagatgaagatgttcttaacgcgacttgggtttaactcgaagatgattgtcaacggcgatattagccagattgacttacctaagaaaacaatgagcggcttggtgcaagctgaacatattttgcacgatattcctaagattgctttcgtacagttcagttcagaagatgtggtacggcacccagttgttgctaagattattaacgcctatgcggcgattgaaaagatgagaaagtaggaacacttgaatggatatccaaattatcgatgaaacaaaagtagttgcagaagcaaacgtaaaactggtcacggatattttagaatatgccgggcaacaattagatttacctgaagacacagaaatgtctgtcacgtttgtgacgaacgaacgcattcgccaaattaacaaggaataccgcgatactgaccgtgcgactgatgtcatcagttttgcaatcgaagaagatcctgaagaagaaggattaccagccaactttgaagaactattcgacattcccaagaatatcggtgatttgtttgtttcattagaaaaagcagctgaacaagctgaaacttatggacattcatttgaacgtgaattagggtacacaatggttcacggcttcttacacttaaatggttatgatcacattcatagtgaagatgaagcacaaatgattccattacaggagaagatcctcgatgaatttggattacaacggtaaaaaaccacaaacgggcaagaataaacatttttggcagtcactacgccacgcactcggtggattatggaccgcctttaaaactgaggctaatttacggcgtgatgcctggtttgcactcgttgcgattgctttcggtatttattgtcagttacattatttagattggttagcgattattttcgcgatttttatcgtttttatggctgaattttggaatacagttatggaacatctcgtggacttattagtcgatcaccagtaccatccagtggctaagcagattaaagatatcagtgcagccagtgtcttaatcagcacaattttagcgctattgattggcgccattgtctttggacacgccatatttaactaaaaaggggactattatgtcagaaacatatcgctcaggctttgtggccattgttggccgaccaaatgttggaaaatcaacttttatgaatcgaatgatcggtgaaaaaattgccatcatgtcatcaaaagcacaaacgactcgcaataaaattcaagggatctacacggatgacaacgcgcaaatcgtgttcgttgatacaccagggattcataaaccacataatgaattagatgaatacatggatcaagcagcgctatcgacgtttaacgaagttgatgccattttattcatgattagtgggattgataaaaaagggcctggggatcaatacatcatggaccaattgaagaacgtcaaaaaacccgtttatttggttgttaacaaaattgacgcgattcatccagacgatttattaccaatgattgaacaatatcggcatgaattagatttcaagggggtttacccaatctctgcattagaaggtaacaatgtccctgaaatgttaaaagaattggaacaaatactcccagaaggccctcaatactacccagaagatcaattaacggatcacccagaatatttcgttgttggtgaattgattcgggaaaaaattcttgaattaacgcatgaagaagtgccccattctgttgccgtggttgtggaacggatgaaagaccgcgtcaatggtaagctccagattgaagcgaatatcattgttgaacgtgatggtcaaaaacggattatcatcggtcaaaagggctccattatcaaagaaatcgggattcggtcacgtcgcgaaattgaagctttacttggcgaaaaagtcaacttgaagctctgggttaagattcaaaagaattggcgtgacaataaccaatacctccgtgaatttggttacaataaaaagagattgtaggcttaagcaatggcggaacatcgattcgaagactttaatggtctagtgatgtatcggaagaactataaagaaaaagatatgctggtcaagattttgaccgatcgctttggcaaaaagatgttttacttacgcggtgcgaataaaccgaagtttcgcttgagtgcggctattttgccatttacccaagctgagtacggtggcgacattcgcgatgatggcttatcctttttaaataatgtcaagtcggcgagtcagtttcaatcgattagcaatgacttgtttttaaatgcctatgcgacctatatcttaggcttagtcgatgttggttttccggatagcgaaccgctcggcagttggtatccgaagattgaacaggcactctcattaatcgatgaaggctttgacgcggcgatgattacgcacattatcgagattcagatgttacaagtcttcggggtgcagccacaactgcaagtctgtgcggtttgtgggcgttctgatttgccgtttgattattctgagagttatggcgggctgctttgtcaacgccactggcacttggatgttaatcgattccacggtagtcaacgggctatctattatctgcgtcttttttcagtgattgatttattcaagattcaatcggtcaacgtcaaacagacaacgcagatggagcttaagacgatgatcgaccggatttatcaagacacggttggcctatcgctcaagagtaagcaattcatcgataagatgtacagtttcgatagtcaattaccacaattaaaaaaagtgtcgtcagaaattgacagcacgccaaaagacgactaaaatagtaatcaacttaatagacgttgaagaaaagggtcccttaagacggtcagacagtgattctaggtgagtgagaactagaacaagacttgagtggattggcgtttcggagtcataccaatgaagcagcagctcgctttgagctgaagtagggtggaaccgcgagtaatcgtccctatgtgacttaacagtcgcataggctttttttatgcgcaaaatacggaaaagaggaattgaaatggttaaaaagttaaatgtgcaagaaatgattttaaccttacagcgtttttggtctgaaaaaggctgtatgctaatgcaatcttacgatacagaaaaaggggccggcacaatgagcccatacacgttcttacgggcaattggaccagaaccttggaacgccgcttacgtagaaccttcacggcgcccagcagatggtcggtatggcgaaaaccccaaccgtttattccaacatcaccaattccaagtggtcatgaaaccagccccattaaacatccaagaattttacttggatagtttacgggctctaggcatcgatcctttggaacatgacattcgcttcgtcgaagataactgggagaacccatcaatgggttgtgccggtgttggttgggaagtttggttagacgggatggaagtgactcaatttacctacttccaacaagttggtggtttgcaatgcgatcctgtgacaagtgaaatcacatatggcgttgaacggcttgcttcatacattcaagatgtcgacaacgtgttcgaacttgaatggggcaatggcgtgttatatggcgatatttttaaagaacctgaatatgaacattcaaaatatgcttttgaagacagtaaccaagacatgcttttgaaattcttcgatgaatacgaaacagaagcaaaacgtttaattgacttaggccttgttcatccagcatatgactatgtcttgaaatgtagccacacattcaacctattggatgcccatggtgccgtttccgttacagaacgggccggttacttgtcacggattcgccggatggcgcactcaatcgcgcaagcattcgttgctgaacgtgagaaacgtggcttcccgctcttaaaacatgctcaagaatcaaacacggaggtcgttaacaatgactaaaccattcttattagaaattggcttggaagaaatgccagcccacgttgtgatgcctagcatccaacaactagaaaagcgcgtacgcgactttttagaagaacaacacttaacattcgggaccatcaaaacttacgcaacaccacgccggttagccgtcttgatcgaagacctagcggacaagcaagctgacattcacgaagaagcgaaaggccccgctaagaaaattgcgcttgatgctgaaggtaactggagtaaagcagcgcaaggttttgttcgcggccaaggtttaacgaccgacgacattacttttaaagcactaaaaggcgttgaatacgtctatgttgaaaaatcaatcatcggcaaacctgttgaaacaattttgccagaactaaaagccgtgattatggcgatgaccttcccaacgcggatgcactgggccgattacgacttcgaatatatccgtccaattcactggattgttgctctattagacgatgaaattatcgatttcagtattttaaacgttacgactggtcgcacaacacaagggcaccgtttcttaggtcaagccgtgatattggcaaaagcaactgattacgaagcaacgctggaagcacaattcgtaattgcggatgaagctaaacgccaaaacttaattcaaactcagattgaaacaatggcccaagaaaacgattggcaagtcgatttagacgcaaacttgttagaagaagtgacgaacttagttgaatggccaactgctttttatgggcaattcgatcctaagtatcttgaaattccagaagaagtgttgattacctcaatgaaggataaccaacgttacttctacgcacgcagccaagcgggtgatttattacctgttttcatcggtgttcgcaacgggaacaccgacttcatggaaaatgtcattgctgggaacgaaaaagtcctcacagcgcgtttggaagatgccgatttcttctaccatgaagatcaaaaggtaacgattgaacaaaacgttgcgaagttacaaaacgtgtcattccacgacaagattggtagtctggctgaaaagatgacccgtgttggtttaatcgcgcaattcttaggccaaaaatttggtttatcagaagcagaattagttgatttgcaacgggcaagtgatatttataaatttgacttagtgactggcatggtcggtgaatttgccgaattgcaaggggtcatgggtgaaaaatatgccttattacaaggtgaaacaccagccgttgccacagcgattcgcgaacactacatgccaattagtgctgaaggtgcactccctgcaacaaaggtcggcgcggttttagcaatcgctgataagttcgatagtatggctgatttctttgcagtgggcatgattccaagtggttcaaacgatccttatgcattgcgtcgtcaagcttatgggattatccgcatcttagaaaaccaaaactggcacttcccaatggccgattatcaagctgcgatgagtgacattgttaagcaacaagctgatttcaaccttgattggtcaaccaatgctgacgcgatcagcgatttcttaacggatcgtgttcgccaacgctttaacggcatgcggcctaaagtccggcgtgatatcgtagatgccgtcttgaagaatcaaagtcaagatccagtcgtgatgttcgaagctgccaaagtgctttcagaccatcaagatgatgcagatttcaaggcaacggttgaagccgtgacacgtgtgttacgactcgctgaaaaagttgactttgcaacaactgatttaacggttgatcctgcattattcgaaaatgaagctgaaaaagcactttacacagcggtcgaagacttacgtggtacaattgctacgaacccattagctgataattacggcatcttacaaacactacgaccattaatcgaagcttactttgatgccacaatggtcatggctgaagatgaagctgttcgtcgaaatcgcttaacacagttgatgattatcgctcaaatcgcccttaccttaggtgatttaaacgaattgattgttaaataaacaattcaaaaggggataatagcatgttacaaatgaaacgggtttatgaagcagcgacagactcagatgggtaccgaattctagtcgatcggatttggccccgcggcatttcaaaagaacgtgccgctattgagacctgggcgaaagaaattaccccaacgactgacttacgcaagtggtttggtcatgagccagctaagtttcccgtttttaaagaaaagtaccttgctgaaattgcagctaatccagcttggccggagtttgaaaaggtagtgcacgagcaccttgagctgggcaacgtcacgttagtctatgcggcaaaggacctgcaatataatcacgttgtcatcttaatgggacttttgaaaaaggaccttgacaacgaatgagatagtttgctatatttatttgcaactgtacctaaatggtgctatgatatatagtgtatttttgtgctgataatccttaaaagtcgcatttcattgtgaggtgcggcttttacagtcttagtacaatttgaattgaatagtgaggtgagaccaatggcgggaaagattccgaatgacgtgattgatgatgttcggagccaaactaacatagtggatgttgttggtcagtatgtccagctcaagaagagcggcaataacctatttgggatttgtccgtttcacgatgagaagaccccatcattctccgttagtgaagagaaacagatttttcattgtttctcttgcggacggggtgggaatgtcttcaagttcttgatggaactggaacagattagttttccagaagctgttacaaaaatcgctgactttgtcggcttcagtttagcggagacttatcgacccactcaaaatgttcaagaatcaagtgaagtgacgcagtttaagcaactctatcgtcaggccaatgaactctttacgcatattttaatgagtactgaagcgggccaaccagcgttagattacttacacgaacggggcttgacggatcaattaattgagacgtttagtattggctatttaccggatcaaaccgatttaatgctttcattcttccagaataaagaagttccgtaccagacactacgtcaatccggcttatttattgaaactcagaccggcaagctgcatgatcgtttttccggccgagtgatgtttccgattcggaatgcgcaaggtgaagtgattgctttttctggccgggttttggtgaaacaaccagatcaacccaaatatttgaacagtcctgaaaccgtgatttttaacaagcggaaggttttgttcaactatgatttagcaaagactgctattcaccaagaacgcaaagtttacctgtttgaagggtttatggatgtgattgcagcgtattcagccggtgtttcaaacggtgtcgcttcaatggggacgagtttaacgactgagcagttgggaattttagggcaacaggctcgggaattaattgtctgttatgatggtgatcgtcccggaatcgaagcgatgaaacgcgcaattaccatgttgcagcaaaataccaagcttgaattgagtgtggtggttttgcccagtggcgctgatccggatgaatatgttcgccaatatggtgctgaacaatttaagacaaccttgcaaaatggtgctgaaacaccgattgcatttgaactgcggtatttgaagcaagggttaaatctggataacgagaaggatcaacttgattacgtgcaacaggcattgtccgtcgttgcgccaattgattcgccgcttgaaatcgagatttacctcaagcaaattgaagccgatagcggcattacccttgatacgttgaagcggcagttacaaacattgcgcgttaaacgggcaacgcagcaaccacttgcaccggcatctagtcagtatgattatgacatgccacctgaaccggatgacgcatttgtgggtggaccaccgccaatcattggtgatccgcgggcaacagcgacgcgtcagccacaacggctaacccgggttgaacacgcggagcaagaagtgttgcatatgttgatggctaatgacgatatgcgcctgcaattggagaacaatgccgattttagttttgtgcataccccgtaccaactgatttacgagttatggcgcgcctttttagctgaaggtaagtcgaccttggccgacttcatgggttatatcccagatgacttacaagccttagtcgttcagattgatgcgcttgacttaccagaagaggcaagtcaagaggcgttaaacgactgtctgttcgtcattgcgcaaaataacgttgaggaacaattaagagaagcgaaaattgccttaaaagaggcgaccaaattggggaatgcgagcgaagaaacgcgcttaaccctggaggtcattagacttgtttcgcaaaagaaattaggaaattgatattaggaggtttctgaatggctgataataaaaaagctgacacgaagaaatttgatactgcggttaaggctttaattaaggaatacaaaccaaagaaagaaatcaccaatgatgaactcgttgcaaaaatcgtgaaaccatttgcgctacaagctgatgaaatcaatgaattaatgcaaaaagtggaagaccaagggattgggattgtcgatgaagatgggaatccaagtgccgctacccttaaaaaggaaaaggtttctgctaaagaattaaaagatatgactgcaccaaccgggattaagattaacgatcctgtgcggatgtacttaaaagaaattgggcgggtatctcttttaaacgcccaacaagaagttgacttagccttgagaatcgaacaaggtgatcaagaagccaagcaacgccttgccgaagctaacttgcgtttggtggtttcaatcgctaaacggtatgttggccgtggcatgcaattcttggatttaattcaagaagggaacatgggcttaatgaaggccgttgaaaaattcgatcaccgtaaagggttcaaattctcaacatatgccacatggtggattcgtcaagcgattacgcgtgcgattgccgatcaagcccggaccattcggattcctgtccacatggttgaaacgattaacaagttaatccggattcaacgacaattacttcaagatttgggccgcgaaccaacgcctgaagaaattggtgctgaaatggatatgaatacggataaggtgcgcgaaatcttgaagatcgctcaagaacctgtttcccttgaaaccccaattggtgaagaggacgattcacacttaggcgattttatcgaagatcaagatgcaaccagtcctgaagaacatgcttcttatgaattgttgaaagaacaattagaaagtgtcctagataccttaacagaccgtgaagaaaacgtcttacgtttacgtttcggccttgatgatggtcggacacggacattagaagaagtgggtaaggtgttcggcgttacgcgagaacggattcgtcaaatcgaagccaaagcattacggaaactccgccacccatcacgttcaaaacaattaaaagactttttagaataaaagagtgcgtaagcaggcgactatattttgagggttagcatagtcaggcgaataaccaacgatgttggttgtttgactgacgtagctagccgcagaaatatgcctgctagagcacgttttcgataaagtgcgtttagttacgggagcaactgagcattaatacaatattgtcattaattcagattttagaattaatggcaatgttagattaagcggaagttgttgaactaaaaagcacgtttaggcaatcaataaaaaggccgcaagctaacctagcttgcggccttttttgcgtgtatctaaacaagcagagcaccaatccccactgctaaaaatacaatccccatcaatgcacctgaccataacgccatgggtatgaagactgaagtactgtggtttgcttcaaccttcaaagtcttgaatgttttaatggtcattgaaagttggaaaataccgatgattagcattaaaatcccaataattggtaaccagttcatgttaccatccccttcactgtaaataatttatcttatgttaactaggatttccgaaaactaataaagctcaaaaagaaggggctaattgacgtttataaccaatcggccgaaaggtttaaccttttttgttaccatcagttttttccaagagagagtagtgattaacctgcagctattagctaatgagatacttagtgttactcaggatgtttacgtggcctatgaagaaccctactagctgtgagtaggattaagctaagtaaaatatagcgcatcgtaattaaaaagccgtttaacagtcccttatgggatggttaaacggctttttgctatgctaaggcgtcattttctgtttcctgataacgttgcaagatgtagattgctaggataactagaattgcaccactcatttctacccaactaaagcgggcatggaagaagatgatacttagaataaatgtaattacaggttgtacggcatcaacgatactgattacggttgatggtgcaaagtttaaactgtgtaacaagcaaagatatgcgaatacagttccaatcaaaataacggctaaaattgcgataataccggaagcatttaaacgcggcggtgcttgccagaatggtcggtggatattgaagagtaaaccactgatgaacatgccccaacctaaaacgagaattggtgatttttcattaacgattggtcttggtagcacaacgtagaaagcagctgttacaccggataagattccccagattaatgaattaaaaggaattgttaaagtatggatattgcctttcgtaatagaaaggaaaacgccaattaaagcaattccgaatgagataatatcaattcgatttggccacttacgtaagaaagcgagggttccaataacgataaacagaggacttagatattgtaaaatagtcgccgctgctgcattccccgtttggatactcatgaagaaagtatattgattacccatgataccgaaaagggcgtaagcgattagccaagccgttaatcgttttgatttaaaaatggagaagatatcttgtttgaacttaattgccccgataagtaataaaattaaacccgcgccaagcgttctaacggataggaaccaagttgcagggatcttttgtccttgcgagatgaattccaaaatagtacctgaaacgccccagagtgcggacgccatagtcgcccaaaacatgcctttggcgatgttttgcggttgagttcgattgttcattgtgcgccatccttttttgaaaatttataactatactattataagctaaatggcgtatttatgctatttgcaaaacttttttcattattattccccacaaaataataaatatggcagtgataaagcgaactggtcaacaaaagctaattaagttatgatgaataaaaaagtgagggattcagatgcaatacattgcgttattacggggaattaatgtgggtggtaaacggccagttaaaatgagcgtgcttaaaactgcgtatgaagcggctgggttcaccaatgtgcaaacatacatcaatagtggtaacgtgttatttgaagccccagaaacaggcttaacaaccttagcggcaacttgtgatcagattatggtggagacctttggcttttctgtgaatatcgccgtggtcacagctgaccagttgattcaagctgttgcggacgcaccagcttggtggggcaatatgccagatgtgaaacataatttaatcgtggcgattgcgcctaaaacgggggcggaattgagtgtacatgtaggggcaattaagccagcgtatgaaaaagttgccgtgaatggtccgtttattttctggagtgcacccgtgaaaacattcggtcggacgcggtggtcgactgttgctaaaggggacctataccagtggctgacaattcggaatgccaacaccgctcgtaaattagtggcactcgcacaggcactacgggaagcatgaagtggttagactcgcatcttcattaatattcatatatacttatagtaataatcaataaagaaatgagggacgcgatgcgcttatccaatttgaaacagacgattatccagatggggttgatcttgattgctctcgaaattattgcgattgggattcaactcttctttgccccccatgaagtagcagccggtggggcaaccggtgtggggatcttattagaagaattgatggggtggaagatatcaacagtggtgtttgtgattaacatcggtatgctgatacttgcttacttcttacttgataagaaaaccacgttaagaattctctttggtagttttatgctaccagtttgtttagctttaacgccccaaatgatggtggtggaagacaaactattagcaattattatcgggagtgttgtttacgctgccggaattgccttgttatatcgaattgatgcctcgagtggtggctcaacagtgccaccgttaattttcaaaaaatatttcaatatcaaaccggcattgagtttgctggtagttgatttactagtctgctttgcgaatgtgttcgtctctggttttgagacgttcatgctggcaacttgttcatcaattctgacgttgattacgatgaactatattgagaccgggttgaaccggaaaaaggtcctctatgtcatgagtaacgaccaattacctgaaattaaagcccatttaatcgaagaatctgatgtgggcgtgacgatttttgatgttactgggggctattctagtgacaataagcagatgttggtgctcgttgttgaaaatcaagcctatcaacacattattaatcgaattcatgaagttgatcctttggcatttacgattgtggctaacgtagccgaggtacgcggcggtagtttataaatttaaaaagggtcgagacaattgtctcgacccttttgtgtgttattgatgattaaagtagcgatcagcttttaaattattgatggtgagcatgataatcaagctgatgatatagagtgttgaaatgaagagcatcacggtcatcaccgaataatgatcaagtaaccaaccgataatcacgctcgaaaagccaccgatacagcggccaacgttcataatcacgttattggcggttgcgcggacttcggatgggtagaggcgactgacaatcgcgccatagcctgcaaacataccatttgagaagtagccaacaattgcaccgacgaacaataaagcacccatgctattgggaagggttaagatgtaaacgcctgctgctgaagcaatcaggaataagccaaaagcaaaccgtggaccaattcggtctagaatccaaccgaaagtcaacatgcctgctgacatcccggcaatcgtcgctaacatccaagttgatgaaccagccacactgaggtgcatttgttgttgcatgatggttggtaaccagttcattaaaccgaagtaaccagcgatttggacgattgccattatcatcagcgcaactgtttggtaagctagttcgcgtgttttaaaaagagcgctaatctgaccctttggttgacctgattcagaagtgaacgttgtactttcgactagatgatggcggataaaaaaagtaatgataacaggtaataggccgaatagaaatagtgcatgccaaccaaattgtggtaagacccacgctgctagaagtgccgctgcaacagcgccaagttgacctgcgacacccacgtaggatgaaacacgtccgagctgtttcttagggaaagattcggctaagactgtcatgccaatcccatattcgccaccagcaccgatcccagctaagaagcgacagagataaatcatggggagggtatgggcaaacgacatggccgctgtcgcaaaagcaaagataaaaatggtgtaagtgaatgttttaatccgtccaacgcggtcggctaaaacgccaaaaaaaacgccacctaacaacattccgatattggtaatcgttgcgattaatcccgcctgtgtcccactgagatgcaaatctgcaatgatggacgatagggtgaaagacaagaacataacgtccatgttttcgagaccgaagccggccgtcgttgaggcgaccaccttagtctggtagcttgttaatctatgttggctgtgtgccgtaatagttttcatattcagttttcctccaaaaaggacgctctctgtcgtcccttattttgcttggtgccaatcttagcacaggaaagtagtctgtgcaagggtgttatggaaaaagcgcaagcgccctttgtgatataattgagtttataaaatggctcttcagcgatggagggcgttatggaggttattgaatgactgataagaaaaaacgctttacttttccgagcgcctacacagtaattctacttgttttactggcagtgatgatcttgacgtactttatgccagccggaaaatatgcgagtttacaatataacacgacccaggaaaacttcactgtggtcgcacccaatgggcatgaatcgacagcacctgggacacaagcaacactgaagaaataccacgttaatacggatttagcgaagtttaaggatgggtcggtgtataaaccagttgcgattccaaatacatatcaaaaactcaatcagcataaaccaaacttatttggcgcgattaaacaatttctgaatgcgcccattcaagggttatctgaaacaatcgatattatcacatttgtcttaattctaggtgggattgtgggcgttgtgaataagaccggtgcatttgcggccggaatggcggcgctatcgaaacgtttgaaaggtaaagaagcctggttaatcgtgattgtaacgagcttgattgccctaggcgggaccacctttggcttggctgaagaaacaattgctttctatccaattctagtgccaatctttatggcagctggctacgatgcgctagtcgcaattgcggcgatttatctaggcagttcaatcgggacaatggcttcaacggtgaacccattttccgtcgtgattgcttctaatacggctggcattagctttacagatggtatgggactaaggcttgtaatgctgattctaggcacattaatctgtattttctacacgattcggtatgctgaaaaagtaaaacacgatccaagccaatcgctcatttataatcaaaaagcagaattggaaaaacatttcctgggaaatagtgatgtcaatgaagtaccacggtttgatttccggaagaaattgatgttaattatttttgcggccggttttgtcatcatggtcttcggcgtgaaggaatggggttggctatttaatgaaatttcctcgttattcttagcgattacgtttattttggcgtttatttccggattatcggaaaaagattttgttagtgaattcgttgcaggggcttccgacctgttaggtgtagcccttgtgattgctttagcacgcggcgtgacgattattatggaacaggcacaaattagtgatacgctattgtactggttaagtagtggcgtttcccatatgagtggtgttatcttctcaacggtgatgttcttcgttttcattctactaggattcttcattccgtcgagttccggtctagcggtgctatcaatgcccgtcatggcaccgttggctgatgtagtcggtgttaatcgtgacgttattattagtgcttataactggggacaaggcattatgtcgtttatcacaccaactggtttggtcttggcctcgctggcaatggtccatgtaacgtttgataagtggttaaaattcgtttggccattaatggcgattattggtctattagcaattattttactcggtgttagtgtctatctttaaaaaaacggtcaaaaaaggtccgccacaatcgtggcggaccttttttcgtgattagtaaactttaaatttcgttactggccagtagcggagtttgacaacgccttgaatcccgttgaaggctttagaatcatcactgacaaagcctacttcttcataccgactatcttttgaaacagtccggttatcacccatgacgaagtagtggtgggcagggactgtggaacgaccaagcacgtcctttaaatcaaagtttggcttattagtctttgggttgagtgtgaagtagtttgacccggctaggaaggttgttggatcttttttatagtcatttaaataaggctcactgacttttttatcattaatatagagttgatccttgttgaagcgaacagtttcaccgggcatgccgacaattcgtttaatgtagaattcacctggtgaatcaggggccttgacgataacgacgtcgccgcgtttcagtttcgtatggcgtagtgcaatgacccgatcatactgtgtaaagttgggttgcattgatggcccgaaaatttgttcattggcaatgacgaatttgagcagtaattgcgcaatgccgaccatcacggccgctaataaaatgatttgtatagtggatttccaaaattcttttgctttagctgacatatcgcacatccttagaattcaatagattcattgtactacaattaattggtagatgacaacaaaactgtacagttccttaactatttaaatgatcttttaaattagggaaatgacgcgttatttatcacgggaaacggttcgtggtatactgaaagggattattttaaacaacaggaaaagtgagtttaacgcatggcgaatttagtaattgtacgacatggcgagagtttagccaatcaattaaatacttacactggttggtctgatgtgccattaacggctgctgggcgcaaacaagcacagcatgtgggtcgacaaattcaagcaaccggaattcaattcagtcatgtgcatacttcgttattgaagcgtgcaattttgacgagttacattattctggatgaaatagaccaattggccattccaatgacgaagagttggcgattaaatgagcgccattatggggcattgcgcgggttaaataaggaaaagacgcgggctatttttggtgcgcatcaagttgcccgctggcggcgtagttacacggcggtcccacctttattgacgactttttcgcaggcccgtcgttatcgactagttccaccgatgagtcggccacgcggggagagtcttgcccaggcaacgcaacggctattaccttattggcaagatcaagtagtgccaggattacttgcaggccaggaccaattgattgtagcgcatggttctactttgcgtgcgctcattaaggtgatcgaacagatttcagatcgcgatattgatggtgtggaagttgaaaatggtgaagcactgtattatcgattcgatgctcaaatggtagtcattgagaagggacgattagcggactaagcggatggacaacaaattgaaaagaggactgctgttggtaggactcatcctactaattattggcggcacgatttatcatgaacggcaaaaatatgccgtccaaacccaacaaaaaatgaaacaacttcagcaacaattacaggcaacaaaacttgaattagccattcaaaaggcaaaaagtcatgaagccgggattgatgatcgaaccatcaatcatttgagtgcgaaggaacaacaatttgtacagcagttgctatatgataacagttttagcgggaccattttaattgtgcggcggaatcgtgtgttatttcaaggtggccggggctatgcaaattttgcgactaagcaactgaattctccacagacgacgtatcagattgcatcgattcaaaagtcattaacggctgcgttattgatgaaacaggtgcaagccgggaacatcgatttagcgacaccgttgagtcgatattacccgcagattaaagaggcggatcaaattacgctgaagatgatggttgatatgcattctggactgactgaattatctgcaccagaaaaagaattatcagatcaagcgcggattcaatatgcgcttgatcatttggctgttaaagatattggtcagcataattattcgccagttaattaccttcttttggccgggattttagagcaagtcacccataagagttatcgagagttagttggaaatcagttgataataccgcttaaattaacatcgtttaattttatgccaaatgaaacgaccggccaacaagcgactgcttatggctatcaacaaggcggctatggcacgccagttagtgaaccaagttacgtatatatgcgtgagttagggaccggaaatatgtatgccacaacgagtagcctctttcgaactgaacaggcgattgttcaaggaaaagtttttaaaaaatcgttattaaaaacgctccgctcatcgactactggtgaatatacgggtggtgtttataattacaaagattattttacaagccatggggtcgaatctggattcgaatctagcttgcagatgagtcatgatgggcgttcaggagttgtcttattatcgaatcaatataaggccaatccttcaattggacttctaacgaatcaactttataagcagttaattacgcttaatcgttaaaaaagcagcttggcttaatgcctagctgctttttgtttggactgtaaaatgatgttgtgcaagtgtccaaaggccaaacccaattaaacagccaatccagtttaagaggatgtcactgagtgcgaaagtccctagataaaaggcgaattggagaatctcaatgcctagaatcgttaagggcgctatgatgtttgtttcaacaaatgaggctttcaaatggtataaaccgcctaatgggatgaaataaacgacattcagtgcggcttcgagcagtgttttgtgatccttttgaatgaaatcgaacgggttcaagctaactgcatgatagacgtttgctttggtgaataagacaatgaataacaagagcagatagacactgtagacgagatagccatagattggcgatagttgtcggcggtcccattgcacccagcccaaccaaaatgtaagggttaaaaatagaatcagaaaaagcgtcgttgctggaaaacgggccataacccgggttaagcgtggataactgttgagtgttggtaagacaatgtgccacacgaagtagcgacttatgaggtaggcgaccacactggctaaaccatattcaagtatcttgcgcattacggttcctccagtgattatagtttggtttgggcgaggcgtttagtgaattcagccataaagtcaaaatgttgtgtgtcggctaacgtatcttctaatttatttagaagttcgttgagcgcttgttgttcgtcgggggttaggctaccgaataaagtctccgtaaattcattgcgaccatcgagggcttcttttaaaaccgctcgaccggccgctgtaatgaagacgtgggtgattcgccgatcatgatgatcgggccgccgattaatgtagtgtttagactctaatttgtgcaagcattcggttagggatgaaggccgaatatcgagactttcggcgagggctccctgcatttgtccgttttcgatattaaggcgttttagaatgcgaatttggctgactgagcaatgatcggatgaaaattgcatgccataataatggcgataatggtgaatcaccttattgaaagtttggaaaagctcgttagatagctcggtcatggggactccttaataaagtttaatttgagatgctaatacgggtataatacgtcatttcataagggggagcaatattgctcaggttttatcaagggcattgtgaataattttacataataaccgcaaaaaaaacgatggttaaactgagtcagttctaaccatcgttttggggttgttattgagctgcttttaagaaatttaatgcagctgcataatctggttcgtctgtttgttcgataattaattcggtgtagctaattgtaccatctgcttccaaaataaagattgagcgttgaagcgtgttgttgcttggaacgtagagttgcattgctttcccgaaactgagtgcctcatcagaaaggagttgcatgttcttaacgccttctgcagcgcaccagttattttgttgttcgatggtgtttgttgaaattgtgtagaaatggacgtcttcgaattgatcgacggcttggttaaaatgctttgtttgaatgctgcaaacacgggtatcaatgtctggcacgacgctaattaaagtccgtttaccgagcaattgcgcagaagtcaccgtttcgccagcggcatttttaaggtcaaattggggtaactgtgtgccgacggctggtggtgtgccgattgtatcgagtggttgatcatgtcttgtgatttgcatttgcataaacctcatttcataataaaagatgcttttattctaagctgattgtgctgagaacacaattaatcacgctcgaggagtatagaaaatgttacgtaaaaaaattcaggcactatacgctaaaaagatgctgaaccaaattatcaaagaggtcaatgtcaaaccgctcgtttatgaaattgtcgatgcaagtgggactgaaaccgcggttttgctaagtcatgagcaatgggttaaaatccaagccgcgttaaccgctaacaagtagcgtgaattcccgatttagacttaatacggtaactaagctgtaacatttctgtaatagttgaatgttacacttgttcttggttggaaaaccgtacataagttaagtatttttaaaaatgataaaggggaatcattcagtgaaaaaagtcagtcgattaatgttcagtgcactagcattcttaacaattgggtcaacaatggcggttagcattggtgcagtcagtgccgatgaagttgctgatacaaaagcaccaatgacaaaccttagtgctgaaaactcagctttattagctaagttaagtgttgcacaagataaggttgcttcaatcgatagccaagtgtcaaataagaccgttgcaattaatgatgcacaaaagaacattgcatcaacggacaaagaaattactgaagtggctcaaaaaatcgttaaagttcaagctgaagtccaatctagaaaaactgttttaaaagaacaagtaattgcgcttcaaaaacgtgctggggatagtgtttctggaaatgtttacgttgacttcatcgtcaatagtgacagtttctcagatatggtcagtcgtgcttcagttgttggcaagttaaaccaagctaacaaggaagcaatggacgccgtagcaaactcagaaagtaaattagctactttaaaacaagaacaagtgactaaaaaagcaaatttagttaacacaaaagcacagttagaaaaagatcaagcacagttaacatcacttaaagcagatgcagaaaatgaacaagcaagtttccaacaagaagtggatggacataagacacagcttgctagcttacaaagtcaattagatgctcaaacagcagccgctgttgaagctgctaaaaaagaaactgaaaaagcaacaattgcaccaacggttgcacctaaaacaggttcagacaatacaccagcaccaacggttgcacctaaaacaggttcagacaatacaccagcaccaacggttgcacctaaaacaggttcagacaatacaccagcaccaacgcctgcaaaaacaacgacagttgcgccatctggtgcaaacactggttcattagttggcaatgccttacaattcattggcacaccatatgtatggggtggcgcacaacctggtggttttgattgttctggtttagtttggtacgctgctaagatggccggcattagcttaccacggacatcacaaaaacaaagcacggttgggacaaaagtgtcattatcagaattacaacctggtgaccttgttttctggggtggcgttggttcagcacatcacgttgggatctatatcggtggtggctcatacgttcacgcaccaacagaaggccaaaatgtaacaacgatgtcaatgcaatattacaaacctgactttggtcgtcgtttataagattaaataaataaaaaagtttggcgtctgcttaaattaaaccgtcaaacttttttatttatttaaatcctgaatagaagagtgtgaatgaatagtgacaaaacaactattagtcattacgggcgccacgggtagtggcaaaacaacggtgagccattatttaaaagaggcctttcaaattccacaagtggttacccataccacgcggcctagacggcataatgaagtcgacggggtggattattattttgaaacaccagacaccttggcacaaaagcacctcgttgaatcggtgaactattctggctatcaatatggctcttcacatgaagcgttagatttggcgtggcaaaaagcaccgctgattagcctagttgttgataccaaaggggcacagacttatttagagacgttccccgaagaagcatcggtcttgttcttaacggtttctgaaacagatgcgttgattacgcgccttgaaaaacggaaggatagtcctgaagcaattcaaaaacggattcaaagtgctgaatttaagcgggatctgatgttaccgagccatttaaatcaacgggcaactgtgttggttaacgatgactgggaaacaactaagcaagccttagcaacattaatcgcaaccctaaaaaattgatcattgaaaataaaaaggaagcctgtcgaacgcgttcgacaggcttccttttaacgtatggttaacccttatgcaaataagtgttggttaaccgaattggtttgtttcactttataactgagtttttgtacggcttgttcaattgtaataccacttgcgctgattttttcattgttcgttgcagttgcgataaatttttgattttgcgtatcaagtgaaacatgataccaattattagtttgattagtaaattccatcgtaaaatctcccttcaaatgactataaatactgatagaaggctaatgaagacgatttcttaaaaatcatctgaattacatcataacgcgcggcctgagataatgcaactattttgtattcggattcattaaaatttggtgaaatttagctgtgcttagctaacggttatgggattaagggtataatggtaaatagtgtggggtaacaactaaattgaagttggtagtaacaagcgccagcgcctgacaacctagaaagcatgtgctagaatggcatattgattaatcgagaggagcggatgtattaaatgagcgaaataaccactgccattgccgtattacgcgcaaatgggtacaaaattaccaagcaacgccgagagatgctacagtatttatcgggatatgaaaatcgctacattcccgtgactcaaatcgacgagcatatgcgcgccatttttccgggaatgagtcacaatacgatttatcgcaacattaaagattttgaacaacttggcttagtagaacaacaaacagagggtgaacaggcccacgttaaatatcaatgcgattttgaacatcgccaccatcatcactttatttgccgccagtgtggcaaagtgattgaattgaaaatgtgtccgttagatttttttagtcagcaaattccaaattgtcaaatcgaaggtcatcagttcgaactctatggcctctgtgaagactgccaagcataatagaaagggagcgttaaaatggcatatcacacaccacccattattccaccagccgccattatttcgttaattatcgtaatgagtgcgaccaacgttgtggcaaatacagttaaacctgttgaaaacaccaatacagagcaatcgtcatctgtttcaagtagtagtgcaaccacaggttcaactagcagcatgaatacatcagaaacagaatccgagtctgaatcggaatcctcatcgacctccgaatcaaccgttaattcctcttctaaggctgtttcaagtcaggatcggacggatacggatgccaactcacaatcatctgatgatgaacagacaacaacaccacaaaatgatgagtcagctgacacgaccacggcaagcagtagctctgctaacacaagtagtagcagtaccactgctatgcagtaataatttgttttacgcgcaataagggggacatttatcgtgttaacttttttagacattattaaccattatttcggttacttaaatattaatggtcgcgttaaaaatcgccttttttcagttatttgtttaattggtgatttttatcttctatataagagtgtgacctactttaaagctcaagcggttggacgaggtgtgattaacctcctcgtctttttggtgttattctattttgcagtgatgaacctgtatttctattatcggggcaaaaatgcgatcatcgatatttcaccgtatgttgaaaaagcgctgggtggtgatccaaacgcgccacatccactaaatggggtaaccgccaaaacccaagtgatctcacaaattcaaccggccactggcttatttgaagaacaaaatctcttgcccgcgcaactgacaatggacgcggaacaaacccaacgtttaggatccttgattaacgaactgattgaatctggctatcttagcttgaattacgcaggcttaagtgataatgatatatatgaacaagcgcaacaattgcagcgaccaatttatgcgattgggaatcaagttgctttaccgttttatgaaatgaaacaagaagcagatcgttgggtgctctatggggggattaacgccattgccaaacaaccgttagcgcagattacgacggttggcttaaccccaatccaagacttagcccaagattatcaacttgcagtcgcccatacttggattacgggtggcccgaacaagatggccgggcgtagtggcgtggttgaaggcaatgatccctatcaattagtggttcagattgcgtaccaagaacgaacaaagtagtcagtggaggaaaataggtggagattcataacgaattcttagatgtcaattatcgttaccaatactacctgctagaattagtagcggataacggcaattattacttaacagtaccaagagccatgaaattattggggatttctaaatttaaaataacgcagtatgtcgaagggattaatgctgatttagcagtgattagccctacaagtcatttgaaggtcaatgctgacggggtatttgaaagtcaaaacatcgacgagggggttgtccggaaggttcgtttagactatctaaagcaatcaaacctctttaagatgttagaatttagcttgctgcaccctgaaaaaaatgaaacagccgacttttgcgatgcgctctttatcgggactacgaaattctatgaactaaaaaagaaatgacggcaatcgttgaacaattcgatttaaaatttaagaagaaccgacttgtgggatcagaaatcatgattcgccagtttatttttgaaatttattatagttattttaatgggattgaaaaaccacttcaaacgggccaaaccgttgcagatcaggcaatggatcgcttgagtgccgacttggatatttcacgcttaccaacaacggataagaagttagagatttacatcaaaattcaatacattcggatgcacgggaaagactatctaacagaccacgtattgactgctggttttaaagaagctcaagcaaacctttggcactcagtcacccagatgatggctaatgattatcgactgaatgtttctggcgaattcgaaattgaagcattgctcaccttcttatttgcagaagggttcactcagtttgaagtcaattggttagcgagtgatttacaatcaaaggtcacgcagttaacgcaacgctttatcgaacaagtcaatgttgttctagcagccgatgcaggccagacaccataatttcaaacggccattcaacaattaacgcaggatttgaattagattcatactaaacaactaacgttttacacggaaccaacaacgttcatcgatgaaaatcagctaacttattttgcggaatctaatcccttattccacaccattattcaaaaagttgtggataaaagtaagcgtaaattagagtggcgtaagcaagctagcatttattacgattacatgtttgcatgtatccaaaatatcccacttgagatattaaaggatagagtgcatgtttgcgtggatttttctcaaggaaagctatataagcagtatatgcaaaaaatggtgaactactttaacaatttgaacatcgaagtccagtcaaccattgatgaaaacacggacttgtacttatcggacttttattcgggtgaattgacctgtgcgcaattaatctggaagaacccgccgacggttttaaattggcaacaattcggagatttggtagtttccattaagaaggagaagctatgaaaacgggtaagacattactttcattaacagtactcagtttgagtgtctatcgtttttcacaaacttttctcgtacaacaggtacagcgggtagaagcagcaaccgttgaaatggataaaaaagcagcagacgaaccaatcgcgggcggcgaaattaacatcacggttaagaattatccaacgaagactgtcactccggatcctggaccaaataccgatacgggaaagccagagataaacgaagaacaaccaactcagcaagaacaaccaacggccaataaaacggttggacccaacattcggcccgaccagacgccgatttttagcgtaccattagctgatctattacaaagcgaacaagttgcatcaaaacaagagacaccaacattggcggcggcaacgaatcagactgatagtttgccagatacggtgcgggcgagcaaacacagcgctaaacaatctgtaacgaatcaatcggatgatagtgatgaaactacgtctaccgactcaaaagataaacaccgcaaacaccatgcacaagtcgaaaaagacattgttgcgttccaaaataattcaggcacaccagcgcctggtggtagtggggcaacaactcaagtcggtgttgttttcggtgaattagcaggccgcagtttatttgccgttcggtaaatcagacgttcagttattaataaggaatggggtggtaagacatgcaaaatacaaagcactttttctatcgattgatattgttagtcacgatgattggtttaatcatggggaatttgaatacagcggtcttagccgcaacaactgctaagcgagagacgacaccaacttctaatattataatcaaaggcttagaaagtagtgatcattcaaaagccgtcccaaatgctaaaattaatctaacctcaacgaccgacaccaaaaagtcatacctattgacctcaaatgatgaaggtctttttaataccatcattgataatcaaagcgggttaaaggtcaatcgagttgatgttggagaatatgtcattagttcagttgaaaatccgattggctatcggttagtcggcgaagaattaggactcaaggttcaagtgaatgagacacagtctcagattgccatttattatgcagaagtggctgaaggaacgattacgcttaacgctaaagcggcggatgaaacaccaattccgggtgttgtgtttactgctactgagaaagctaatggggttgttcaccagttttcgccaacagacactaatggtatgactaaacttaaattgactgctgatagttatacgattgggttacaatcagcaccagatggctatactgtttcagatgagttaccattttatagtttgggtagcaaatatgaatattgatgaagatattcattttaattatcagcaacaagcgggaaatatcgaagtcaacgtgatggattcggatacacaagcgaaattagcaggtgttaaaatggcaatcgcgtctgttaaaacacctagtcagaaacgaacgacgacgacggatgcagatggcgctgcgcactggtctgatttggcagttggtcaatataagctaacggttgaagaaatgttacccaattacgtggtaaatggtctaagtgaacaacttatgaacgttaataatggcgaaaccgcacagcttatgctgacggctagacgacaaacaggcgctttccaaattcatagtacctctgaatctggtcggatgatcccaaacgtcagctatcaagtagatgctttagacggtagtccgcaacgaacggtgcaaaccaacgaagccggcgtggctgccttgaccgggttaaatgaagggctgtatacggttaaagaaacgaaagtcccaaccggctatcaacttgctcaagcagaacaaaccgtgattgtccgcaatggttaaaatccagacgtcacgtttgtgcatcaaatcgcccgcaccgatgcggatcatgatttggttatcaaaatggctgatcatttaggcaacgccgttgggatgtccagttccagatcaaacaaattgatacagatgaaccttatagtcaaacggtaacggtcgatgctgacgggcaggcgcgcttgcgtcatattccaattgggaaatacgaagtgctgcgagaaacaacgccagcggggtgtcaagcgggacagaaacaacaaacactcattgtcagcaatcaacaaccaaatcaggttgattggacgtttgatcgcgaagtcagtgcaattcgtttaacggttacgaatgtgagtagcaccccaattaagggtgcttcctttatcattaagacgaccaatccagatgatcaaggacaacgcacgttcttctctgctcaaacggatgatcaggggcaagttgagttacagaatttgccattaccaatcaaatgagtcaaccagctgcgaagagtcgggtgaccgtgccgtgcataagctcagcgcgcaagggcaaccgtcaacgggagcacaatttaagcttaccaaagctgatggcagtgaaacacagacgaaaacaactgaaaatgggcaactatttttcgaggatttgacgactggtcgttatttagtcactgaaactaaggcgccagcgggctacattttggatcaaacaccacaaacgcttgaagtaaacgataaggcacgggttaaccaagtggcagtctttgtcgatcaacgggaaactgtagcgccaaccaatccacttacgatcagtgcgctagatccgaatggtaatgggattgccggggcagtctttaggttatttatcgatttaccagatgaccaaggtcagacgacctggtatttgacgaccgataaaaatgggttagccattctgcctaaagctgttacgggtcaatatcacattcagatggttaaggcgccaaatggttatcagttgaacactgcggtttatacgatggcggtggatcaatatgggcctaaccatctgaacattgtcagtgaaaccatattagacgaattacaaacattacaaattcgaaaaaccgacacgcaaggccagccattggcgggcgccgtttttgatgtcgtttcaatggcaacggggaaagtggtccaagttgaatcgaatgaagaaggactggcagagctgaataatcttagtgccggtgattatgaagtaacggaagtcaaagcaccaactggctatcgtctagatgctcaagtacatcgagtgacactagaaaagggtcaaccgattaccgctatgacgattcaaaatataacgcaaaacggcccattaacgattaataaaacggctgaatcgggccaaacattagcgggtgcattctttgatgttcgtaaccagcaaggtgacttggtcgggaactatcaaacagatgctaatgggcagattaaactgaccgatttaacaattggggactatacagtgcaagaaacaaaagcaccagatggttaccaaattaatgcaaaaacgtttaaagcaaccatttctgaccagcacacgtcgactgtcaacgtcatcgatcagaaagtaacgctagaagtggcgccggggacattggtgattcacaatgttgatcagaggaaacaaacaccactagttggagcaacgaccaggttggaaactgcagctggtaaggtggtccgccaacagattgtgattggcgcggctgggcaagtcgttgttgataatttaaaagcgggtgattatcagttgattcaaacaaccgcagcaacggcttatcgcgttacgccaacaccaattgccgttaagattcaaggtaaccacgaaataacgccaattacggtcggtaatttccaaattgcaggctctgatattgttaatcaagtggacggcaataccaacaaaccattggtcggtgcgaagtaccaagtgcaatcaccaaggggaaaagtactagtcgataatttgaagagtgatgaacgaggccatgtgattattcggcaattaccaccggcaacgtatcggttagtagaagttagtgcaccaattggttatgacacaattaaaacgccaatcatctttataattacagagaatggcgttacaacttataattagtaattaatcctaccataaattgtgcaaatagtaactattgcgttgtttaaaatcaaagattgctttttacgtcagaaatgctagaatatttaagtgacgtttggttgtaaaacaccatatgttgtatatcaataataatttaaacacattttatggtcaaaagagggagactgatgacattgctcgtacttgctggcacaattggtgcaggaaaaactagtttaaccaaatatctatctgatcacttaggcactgaagccttttacgaatcagtagacgataatgaagtattaccattattctacaaagatccaactaaatatgcgttcttactacaaatctatttcttaaacaaacgatttgatagtatcaaacaagcatatacagatgataacaacatcttagaccgttcaattttcgaagattcattactcttccacttgaacgctgatcttggtcgcgctaccgcaaccgaagtccgtgtctacgacgaattattagccaacatgatgcaagaattgccatttgctgcccacaagaaacgccctgacttattaatccatgtacgcgttagtttcgaaacaatgctttcacggattcaaaaacgtggtcgttcatacgaacaactagaagccgatccaaccctctacgactattataaagaattaaacagccgttatgatgcttggtatgaagcctatgacgaaagtcccaagatgcaaatcgatggtgacaaattagacttcgttgaaaacgaagctgatcgtcaaaaagtcatcgaaatgattgacgaacgggtgaaagccttaaacgcagaacaagaagcaaatatgggtgcctaattgcacaaaaaaagccgttcgacaaattgtcgaacggcttttttattatgcttgggtacctttttgcatccataattcatgaataatgccatacagccgggcatagtgatcgctactagcatttaagcgccacgtaaaatacaacgcctccggattaacgttttcgggtaaggcaatgctcgacgtccgaacaatcaggtctgcatcccgtaaagcttcatcggtcgtactaacagcgacatatttgatattatcgagtgctgttaagatatccatatagccaatgtaatcttgctcaatcacgagtgcgaccttcacctggcttacaggatgatactgctggatgacttgttgaattaaattatagtaagcctttatcaaattctcccgcccacttgctaaaaaactaaaagctggttcgaataagaggtaatctacggtatcactaatttttttatggagtagttcattgggttttagctgcggcatacgaatgactaattcattaaaaacgacagaggtcgcgtccatcccaaggatataggtcgtcaccgtagtcgttaacaacgcatttttgaaaatatcatatgtgtgctgcgaaatctctaactcatgcataatatcaaatggaatacgctccaaaaaggcagtcacaaaacgatgaatttctggtatataacgttcatctgcccaatcagcagtcaccttagtacttgttattgagcgtaacggtactggacaataccgtaacaagaagaatagtccagcggcttctgaacgcccttccgttaacgttaactctgccaaacaagttcgtaatcccgttgattctttagtgaaatcggctgcaagtaaatcactgattaaattaggatagggataccgaatagttgctaatttttcatcgggctgcacgactgcaccggccatcacccgataataagttactgccagaatcgtggcgccaatttcgcgcgttaataggttaggcttttgcaattgaaattcatcgcagacatagtcaaagaccgacaaaacacattcgtggttgatttcttcaaatagccattgatgcccaccagacgccaaccagtataaggcggataagaccaatcgaattgtcttctcatccccttccaaccggattggttcgtatgaaacccgtaagttgaaggcgcgggttagatcgcggacttgcttcaaatgacgtaatacagttgctttactactatcatgctctgctaagaaggttttaaacgatatatccccgccccgcaatagaatctgtacgaaatcatagatgtcagaatgttgtactaaatataaatgatagacatcacttggaattgcgaagagtcgcttaacatcatcttcctccgtccctaatattgcctgcagatccccaacaatactgacatacgtattgtataagctactataattacggtctaacaatgttgccacttgcttcaaattgacgtcatcgattagtgcttcgccctttttagccatgctcattcgttttctaatgggtaattcatcccatttgacattaataatatctaagaaaagagcatacttatctttttctgccgatgttaaataaacactattggtatccacatttcctaaccccttgttccaaataattgatatatattttaccatcaatcgatattaaagcataaccattctacagcgatatttgttgcgtataacaaaaggcgatgcgttattaacacacaccgcctcaaaagctgaaaataatttcatcatcagctctaattaaacctaacacgctaataacttaaatcaccaattgccatttcaaatcagcattatatgggccaatctgataagcatcattataaggtagtgataactgcaactgactttgtttccaaccaactgtggttccataactcgttaaatcttgctcactgattggccgctgtagaatcccatcaatccattgattatcgggtgactcattagttaatgcttttgcatcactatcatttaagcggtatttaaaattttcttgcatataaaagggattattgggtcgttgatttatccccagatagcctagttgtaaatcaaaatgactacacaacggattacatatgactactttcggcgcttttggtgtaccagtatctgccacttttagttgtacacttggtacctcatttagcgcaatcgtccgattagtacccccctactttgacccaaaatttcgtcatcaaacgtaattgttttcgggatgccaacctctactgccccgtttaaagttaatttgaattggaatttagcgattggatttaaatcatcatttgcaataggtgcacttgccgccttttcagacaacgtaaactcaatgtcgcttgtccgcatgacatcacaatgcagcccttgctccgtagtagtcggattccctgtctgattctgactagcattaattagctgtgccataaagctctccgataaatgcaactgcgaatcggttatcaccggttgccacactgcattttgatctgcattaacacgatagtataacccaaaagaatcaggcgggttcactaggtcgacttgtcctgtaatcccgtactgcggggccgcatgcagtgtgccatccgcataattaaactgcgcatggccattcgattttacagactgtgcatttttggcacccggatcagctaatgtgacagagcgaatctcaggcacctgaatgcctggaaaatcgtggccctgaccaaaaacggctttatcatgattgggtgaaatcggagcatcgggtatgtagactagttcacgaataatactttcaagtcgcgattaaattcagtatactaaatttagataaacaaacttactggaggatagtattcatgcggacttggcaaaaatggactttgattgttctgacactcttcttaataccaattatgtattttgagaaccaatattttatgagagagcagtttaaacagtcgcaaaagaatatgcagcagtcaactttaagtgattttaatgaccaagcaagcggtcagtacgcggcctttaaaatctacgctgtagccaaaccgcatggaaaaatctattattttgtcccacaaaaccaaaatggggccaatatcgatttacaaaaacaagaagtcgcactcggtaatcagctttatgcaaaagcacacaaagaatcacccgacattgaccatatcacattgtacgtcagttatactgctaagaacttgcaagacaatacgtatgcttttaagccaaccgccgaggcttatggttttgtaaaatcacggtttaaaacccgttatcaacgcttgttttcacaaactgggactgaagccatctatgatatgcagcacaatacaacatcggtttcgtttaaagatttgcaaaaagatagcacaacaattccgatgattcgtcaacttgcaattgaccaacaattacaagcccataattatacccccgaacaacttacacaattggaagcacttgatttcccgggaaatgatcaagcaactaattttgactttacaaccgatggtctaacattgaaattcgcaaagaatcctcttgatattgaaacaattgccctgccaatggcaacggttggtccatacctcaatcccaatcttgtcccagaagacaatcaaatgccttccaaaaaaggtggtgctaaaaagattgcactcacctttaatacgacattaaaacctagcactattacgagtgtcattaatcaactaaacgatttaaacatcaaagcaacttttttcactactggtaaagcagctaaagaacatccggatcaactgaaacaattactcaaagctggccatgtcgttggcacccaagcgtataacaacgatgatgacttggatacaatgagcgcgtcagaaattgccgataacctcaagcaaaccgatgccgcctacttcaaagccagtggtcaattgccacacttattacgggtcacaaccgaaacccctagtacggaattaacaaccgctgctagccgggcactaatcgcttggagtgttgattcggaagattggcgcttagatattgatgcgccgacagttgccaaaaatgtaaatgagcgtattacaggtggtgatcttgtcctactgcacacaagtgaggcaacgattaagacattacccgcaattgctaaagaacaaaccgctcaaaaacgacatttcgtgacagtcaacgagctcttcaagcaacgattaacaccttatcaacaatatttcaaagctggtgatcaacgctcgctacaataacgcaaaaaggcccgacaacttaaattgtcgggcctttttgtaatctaaacgtgctccgtaagccgcacgctatttatgttttgataaatcaacttcttctagtggaatcatcttagttttgtaccgtactttatagtaaacatatagtacgacaaacaatggaatgctcatataactaatcccaatcgctgtccaatcgaagttcttaaaggcttgaatatcttgccctgcaatcaccaataaacaaagcacgaatgcaaaaatgggaccaaatgggaaccaacgtgcatgatatttcaattcgctcaactgatgaccttgtgccttgaacgcacgacggaaacgataatgtgacacagcaattcctaaccaagcaataaacccagtcaacccactagctgccactaagaataaataaatccgagttccaaaaatacttgtcacaaaggttaaagctcctacgattgttgtaccaatcagtgccattactgggatgccacgtttgcttgtcttagcgaaaattttagctgcatagccatcttcagccattgaccacaacatccgggatgaagcgtacatccctgagtttgccgctgataacactgatgttaagatcactgcgttcatgatgctggctgcagaagctaacccagcccgtttgaacactaacgtaaatggactaacagcaatattcgtttcactcgcgcccaacaatgagtggctatcataaggaattaaacaagcaatcacgaagattgaaagaatataaaatagcagaatgcgccagaaaacttgtttaatggcctttggaatactcttttctggggtctttgattcaccagctgtaatcccaattagttcggtgccttggaatgagaagccagcaacgacgaagacactcaacatcattggtaacccaccaacaaatggggccttcttataagtgaagttactcaagccagtaggatggccacccataatcccgagaatcgttagtaacccaacacctaagaaaataatgaccgtaatcactttgattaacgcaaaccaatattccgtttcgccgaatgatttaacgctcgtgatgttaatcaagaaaattaataatagtgcgactaagctaaaaatccaccctggcatatcaggaagccagaattccgtaacgagtgccgcggtactaatatcaaccgccaacgtaatcgcccagttaaaccaataattccaccctaacgcaaaaccaagggctggatcaacaaaccgcgttgcataggttgagaaagaacctgagacaggcaagtacgttgccatttcacccaaactggtcatcaagaagaagaccataatcccaatcccacaataggctaacaatgcaccacctggacctgcctttgcaattgctgaaccacttgtcacaaacaagcccgtcccgatactaccgcccaacgcaatcatcgaaagatgccgcgtctttaactcccgcttcatttcatttcctgccataatacttcgctcttttctctatgatttcaagaaaaagccccaaccacgttctagcaaacaaaaaaacagtctttttgtctgctaaaaacgacaaaaagactgatagccttataatatccgttgatagcgccccgtaacatttcgttacgacagtccttgatttattaaaccaagtcccaacatcaaaatgaataagcaaattgacatttcggcaaattcccctttaattatccctcattactgcttagtcagttcaggataacgactcatggtttttgcgacctcttatcttgttagaaatgagtatacagaattcacacaaccacgtcaattatttccattaaaaaaccacgattatttcaatcgtggttttcattttgcttattgttctttatctttgcgtgatttccgccataaaagaattatcaatagtaggataatgacaatcataataccgataatgacatataaccaccagttattgttctctggtaattcaacggccttatcgttatattttgcaacttcctgacgggtaatctcgaagtttttagaaagtagccaactccccttattcgatgttgcgcgtaacttaatattatatttaccagcttttaatggttgattctttaaatcaatcccgtaattaaagtttgaattaggagccatctctaagtcgctgcgtttgttctgatacagaaccttgtttgacccaactttgcggatttcacctttaacagccatcttaccgactgaattggctttgacgttctgaacattggctaaaacggcagtatgactattgagcaatcctgctttcaccttattcagccgtagactaggatgcaccatttcatctgattcagtcagtttagccgcaagaatgtaggcatattggttggttaaagtagccccaccttttcgttccaacgcctgatcaacctgactcttagggacttgtgaaatataaaagccacctaaaaccagccctttaaacgattcatttggcattgttaaatcgaaagtcaccgtctgttcaccgttagctggcacctttacccgttgcgcgcccgacatcatatcactaaacgaatactttaacgagctatctcgtttagtattggttcctgtataatcaatcaatccattttcgttggttgtcgctgtcgtaggggtcacatcgaccgtaattggttttgttcccctattttgaacccgcacaccaacttcttgtttttgaccaggagtaacttttaaatcataatagcccaactccgtatccgtttgattatcaggatagacgggcgtaaccgaataagtcactttctccgcctgaactggttgatgactaaccatcaacatcaggccaaaagtggcaaccaccgctaataacaatccaaatcgttgcttcattcgtctcattctattcgctactccttctaattaagggttcggtgttgatccttgaagaatccaattaatctcaccatgataactccctttatatgcactgccattcactttcaaaagaacaccttgattatcgttccaacttactggggtcgtttcatcatccgtcgttgttactttagaagcaaccttcacaggcatcttgccgatatttgtttgtttattgttaccatcgacgtagactagaccaccgctaagtaattcaccatcagtatcacgctgtaaatagctgcccgttaccaacaaagtccaatcagaaccagccccgcggccatctgaaactgttggtgcccagtcagcagcgttccgttgcgcaataacgttctgtcctacttcaaccggtttaaatccaattgtatcattaaccttgctaaaggttaagtccccacctttaactttgaagtgcaccgttttaacctcagacttctcgttatagccagcattcgttacatagaaagtaattgtatgatcgttattcagagacaatccgtctgttggaatattactaattaacttcccaccagtattgttttgggcaactatttgttcggcaccattatcaatactgtagtgcaatgtcccaacagcgtgcggatcaatcccaaacgacgatagctggctccatgtgccatcgatattaagtggttgtccttttttgattgtcactggttttgccttatcttttgcagcttcccaatctgtacccaattccagctgtggcacacttgtcacataggctgttgtttgtgtggattgactaacagtcgtccccaccaaactaatatcataatgacgccctaagttagtcgtcccatcagtgggtgtaggtcccattgccgtcaacgtaaatgttgacgcagctgttttaccaatctggatatcgcctaaatcaaccccagtactgtattgcgcattgtttgtcccaaaaaaatcagcttctgttgcagaacgctgagataacccggtgcccgttaaactaagttggggagttttaactaagttagtcgatgcaccatctttcgaaaccaactgaccattaaccgttaaatcatgccccaaataagaaacgccaccagcatcatctgatgttccttctgtcttgtaccgtaaagccactttcttccatgctgatccacttgtagcaaggttattagcactaataaccccgtttaattcttcaaatggcttagccggattagctttagtcacttccgcaccatctttatggtagattttgtagctttgagaagtagttgggatattggaaatactcttgaaggccacttgattcaattcagagcttccaccagttttacctgtaaatccccaatatacattggttgttccgaatgcagcaatcggattaattgaaacacgtacttcgggtaacccttgaaattgatacgacagaatctttgtcgttgcattccagttcacattaaactcgtgccatttaccatccgagagatacgtatttgcaggtaacgtttgtaacccttggtgattcataaaacttgtatagcgtcgcctatctgtcaataaagaactagaacccgagacacccgtaaaataactacttaaatcagctggtaagccaaatgcaatatgatttccattaattaatttcgttgtataactataatttgtaattccaagaaacgatgatgatgtatttttaggcgcttcagaaacatcccatttatcattctggtaggtatcaaattctacagcaaaactcttttggatagcatttgacaacgaaatttttgaactactagagtcaacaatcggatcagcccagacaccaagctgttgtcccgttccaccggtctgaattgtcttagttccgcgtggatcattgtgcatcacaaaagccattccatcggctgcactagccccggaatccccaaagttcagtaacatcgttgctgaaaaatcattacttaaatccagtttattattttcattcgaccagattgcacctgattgatttgtggtgtttggattaatttctgttacaccattgactggtaagctactatttgatccgacaggaggtgctgcaaataaattttcaatatttgtaatatgatctggcacaggggcaatcgttgcttgaacagactgatgcataacaactgttgttccaactagcattccgattcctaacaagatttgtttaaatattttattaaaacgcatcgttaatccccttaatgccgttttaatcaactgttacctcaatcgatttcattgtagaagtcaactgaggtaacagctcattaaatgagctgtttttaaaatcatttcattaggcgttagggctagctttcaaagtccatgttaattggccttcatatttgccagcatatgcacctgaaagaacattcaatgttgatttagaaatgttatagttccagttccccattccttgatctttaccagctgtaatgatgtttttagcagctgtatctgttaagacagcatctttagtatctgaaaccgttttgccatcgttattttgactagttccgttagcgttcttcaatgttagtgttgaacctgctaatgtatgtgcgccagatgtgaatggggttgttaaagcaacgtccactgtatagccagcacctgtcccacgtgagtcagaaacagaaaccgtgccatcagctgtttgatccattgtaagtgcttggtcagtaatttcttttgtcccaaaatccaaatctggaacggctgttaatttcagactacctttatcatctgctggagctgtcaatgttgcagctacttttgaagtgcctgattggccatctgtagctactgctgcaaatgcttgtcctgaaactgctgataaacttgcgactgtcaataaactacttaataataatgtatattttttcatcccgaataacctctattcaattatattttagattaacggcactatcaatagttaaggcagattattgtttaagctcctattaaaagtaatactgttaacctttcgaaaatgattgtatcacctcacaatttagttgtaaacagtttaatttcaaaagtagataaaatttatctttaattaacggcgtcacttatgccctgccacaaaaatgaaagcgcatcactaatataggcgttgatataacaacatcatttctaattcagagtacgttttatgtaataaaataataagttttcagcaaatatatatttttaattttgatgttaattattttcttcactattaatcttaaccctttgttaacaagtggtacggcgttaattggatatgccattgtccattttttaaataaattctcaattttctgaaactatcaactaatcaattgaaaactaattttcaattccagcacaaaaaaagcaatccaacaaccggattgctttcactctattttaaatttttaatgatcttctggatgagtaattcacgttgttcggctgattgattccaatcaatcactggaatggcttggtgcccaattgtctcaataatcaagccagaaacagtttgccgttttaactcgttcgcccatagcatgtccgccttgtggaacgcagcgttaataatcaatgttccttgtttagcaacgggttggaagtcattgaagaccgtatccaacttacccgtatctggataagacttaatttgtccttccgtggccaacacaacatcgtagattgaaacttcatcagctggccgcgctagtgtaaaaccaccactattaccagaagccgatttcactagcccagccactactaacttacgaataattttgcgtaggtaagtctgtgacccgcctaagcgatgatgaatgacttcagacgaaattgtgtgttcaggatcttgcgtcgccaaaagtacgataatacaagttgcttgttcaaacgcccgcgttaaatgcattagccctatcccctttttaacagtcgcgcactacgcctttcgcgtcttagtgaatgaaccagaggattgacctgcgtcggtttgtacctcaaacccatatttttcaagaatgtgtgcaactttcttaaaatcatctctatcgaacgtactgatattaccatcaattgtttcaatttccaacttattcgctaaattacagaaggctttcactgccaattgtgctaaaccaagattttggaaatcataaacagctaagcgtgaagctgctcccaatgtttcaagaactgtaatgtgcatttcttttttccatttattggtttcaaataagagttgtgcttgaaaatcaaccgttgaatgtccaaagcggtcgacattagcgtatggtgtgtagacaaaaatcgaacttgtcgattcttgttgaccattttcgcgatagtctgtatagacgatgtactgcttaaccttttcatcattaacctgattcatacttgatagaatcgtcaaattttcgtttgcctcaatttgcgctaactttcgtgcataggcttggtcgttttcgtttgccatttgattaaccccccatttgtctttcaaaccgattataccatagctttctcatttaaaccgtgatttattacggttataaccatgttatttttacaatttgaaaacgttcactattcggcggtagtactgaactcgttgcccgcctaaataatccggtagttgtgattgataagtcttctcgaactgaactttctgtaaactcgcttgcgatgcttggttggttaaaaagcattccgcattaaaggtgtttacaccagtttcttgcgcataggcttgcatcgttgccggcaatactgcgctgataatcccacgtcgttgatacgccggtaagatggcaaaactgagttcatatgccgcgactaattgtccatctacactaagggtaggggcgagcattatcaatccctgcaccacctgcgttgtgcgatcaacaatcgcccaagcatcctcatcattcatcaacattgttagaaacgactgcgcttcttgttgagattgaaaagccgtcatatttagctgcgtcacaatcgtttcttgacaaccaatttgatagaccacttcaagatccattggttgaaaatgccgtagttcagttgtggcagtcctaatctgcatctagaacaactcctttgtcatatcaacactcatagtaacccacttacagtgttgcgccaagtaaattcttatgtttccattaaacaaaagcgccaaatttgtggtataccactttttcagtttatactaataacgattaattactcttgtagaaagcgagcataccgatgacattccgcgattatttccatttattttcgaccgtttctcaacaagccgaatcctatgattattttttacactttattgagacacctgttcctgatttacaacggtatcccgaattaactaaaatttgtgattgggccgcttatgatgatcacagttttcgtctgtggacaagcttgcccctcgacgaattcgagcagcgttttgctgaaactgtcccattaccaagcgattcttaccagttagattacagttacaatttgcaagatacaaattttttctaaagttcatgcttgacttttaattcgaactaccgtaaattgaataacaatcataagtcatcttaattcaaactaagtagtgcattatctgggtgtcagaaagtcggtggttgctgcgaaccgatcagggtaattgttacgaaatactgaatggatgattcggctaattaacaggaccgttatcacctgtaagagtggtgtgttaccttaaaatgacacgctaactgggtggtaccgcggtttccaatcgtccctattcgcatcagcgagtagggactttttttgtagagtgcgttatttagcgcttaatatctaaacatttgcatagaacattgccaatcaaaaacacatttcaactatggagggattttcatgttcaagattgcatcgtgcgggggaatcctccgttatcagtcttttgtcgcaccagcctaaccattaaacttaaaaggatgcgatttaaatgacaaaacacaaaactagtttattagaagcaagtatcgttttacttattctgctagccatcatgggtagcggcgtgattgttttccaactttcaccacaaacacccgtcttaacggcgattgccctcttgattctatgggcccgttggcggcactttagctgggacgccattcattctggtatcgaagatggtctcaaaagcggaatcattcctatcattattttcattctcgtcggcgccttaatcagtatctggattgccgccggtgtgattcctagcctgatggtctggggcttcaaaatggtcagtgtccactggttcattccctcgattttcgtcgtctgtgcgcttgtcggcagtgccatcgggagcgcctttaccgtcatttcaaccgtcggcattgctttcttcgggattggagccacactcggactaaacactaccatcgtggccgcagctattatttccggggcaatattcggtgataagtcatcgccactttcacaatcaacaaacttaaccgcagcggttactgaaacagatctatttgaacatattaagaacttgatgtggaccacggttccagcgtttgttggctcattaattttatacgctatcattggccacacctcgaaaaatgtctccctcgataaaattggtgcggcggttgctgtcttaaacacgcacacttcagttagcctacttgcactaattccaatcatcttaattttcgtttgtgctcgccttaaaatgccagcaattccaacactctttttaaacattgccgtttcaatcggtttaatctttttccacaacccacacacaccaattgctaaaattgcgagttacattgaaaatgggtttgttgcccacaccggcgataaaagtatcgatgccttgctctcacgcggtgggattaatagcatgttaagcaccgtcgccttaattatcttgaccttaaccctcggtggcctcttaatgaagcttggtttaatcgaacgcgtgatggcccctcttgctacccatcttaagacgccaggtcaattgctcagcgccgttattgcttctgggattggcgttaacctctttatcggtgaagaattcctttctgtgattctccctggtaaagccttcaagagcacctttgaaaaatcaaacttgagtaatcttgctttagggcgcgcccttgaagatggtgggacagttatcaactacctcgttccatggggcgtcgctggcgtttttgccgctaatactttaggcgtccctaccttgagttaccttccattttgtttcttcagtctcttatcaccaatcttctcaattctcagtgccgttactggcatcgggttaaagagaaaaaccgcctaaacacgcaaaaaaggcccaggataaaatatcctgggcctttttttacattaattgcattaggaattgaccgccatacaccagcgcaaaactatacactgcaattgaagctggcttgcataaaataatgatccatgtaaatttcttcaatgacatctcggtgagcccagccatcaagcacaagacatcgtctggtgcgaccggtaagaaaatcgcaagtgcgaagaagcgcgcaaagtttttcttttccgtaattgtcccgatatacttgtcatacgttttttcactgatgacgtgtaagatgaacggcttcccaaattgtcgtgctaataagaagttcaagatagaaccaattgcaatcccgacgtaattataaacaaacccccaaagtgggccgaataccaaaaccccggctgcggtgctaatcccgcctggaatgacaggaatcacaacttgaataatctgaatcgtgatgaaaatcagcggaccaattagcacagagtgccccaaatacgcctgcaacgcggtcgtgttattaaaaagaccaagccgagaccaataaatagccaatgagatgcttccgattaatgccatgagagacgttgcgctgattaagcgtcttgaaattgttctactcatccgctgaattccttccaaggttaattttaattataatttaccacattcaacattattttttatcggtcgctagtctgatttaaaaaatcttaactttctaagaacgtccgaaatggtttcaatccttgtgcatgatatttttcaacaaaggccgctacttctgctggatcctgtgtttgatcatcaatcacgagttgttcaacgggtaacgaacgttcgttagcaattttaacatcaatcacaacaggttccttcgtgcctttagcagcagcaaaagcagctttcaattcagctaatgtccgtaccgtaaatccttttgcgcccatcgctgttgctgctgcaccgtaatctgccccttgaatggcaacccctgaatgtggttgacccttatcatcttgttcagcttcaatgaatccgaatgaatcgttgcttaatacaacgttgatgattggcatttgatatttaacttgcgtgataatatcttgcatcaccatcgtgaagccaccgtcaccactaatcgaccagatttgacggtcagggtaagcagcctgggtcccgattgctgcaggcactgcgcaacccattgtggcataccatgctgataacgtcatacgttggcctggatgcattttcaagaaacgcaccccatcgattgaaacattcccaacatcgagattaaagatggcatcgtcagtggccatctcattgatttgtttgaagacgggttccacacgtaacggtgtttgatcgtcttcttcaaaactggctttccattcattccagttttctttattggcgagtgctgctttataaaaggcggatttttcggcaactggttcactcgcggctagcaatgcctttaacgccgtcttagcatccgctaaaattccgacatcgacatggtgtctgtgtcctaatttagtaggatcgatatcaatttgaataaatttggcatctggcttgaagaagtattgaccgaattcataattgctaccgacaaataagattagatcagcagcttctgccaaatcaactccgggtttcgtggctactcgcccagctgaaaccatataagctggatggtcatcggcaacaatcccttttgaaagggctgatgacatcattgggatactcaaccgatcagataaagcaaccaattcttcacccgcagcacgtgcaccctgaccaaaataaataatgggttgttttgcatctttaattaactgtaatgtacgatcaatatccgcgcttcttggctctggataattgcccatttggaataagtttgcagtggcctcgaagttatcttcaatcggttcccagcctaggttagttggaatcgtgacaactgctacgccgcggtgtttataggcttgttgaatggcttggtcgactacaagtggcatctgttcagccgtcattaccgtccgattatagactgccacatcagcaaacatggggttttcattcatttcttggaaataatccgtattcatcacacccgtagcaacttgtccaactaatgctaatacaggaacattatcatatttagcatcgtagagaccatttaacaagtggactgcaccaggtccggctgagccaaatgtagcagcaatcttgccagtcgctttggcttcacccgccgctgctagtgcaccgacttcttcatggcgcacttgaatgtaacgcataatcgctttctggttatgtagtgcattcatcgttgaatcaaacgagccaccgggtaaaccaaaaatatggtcaattccccagtctgccatgacttttaacattgcatctgatgcgtttattttctgtgctaccattaataaagacctcctgatgattttatgtttcacttacttaagtatatcgcttaaaatgtaagcgttacaaataatatgtctttttttaattattgggactggtaaaaaaaaccattttttggtatgcttgcactgagctagataataatgattataaataactaactttaaatttttatttggaggttctgaacatggcaattacacccacagatgcacaagacgtttttaaagatgctggcgagaacatcattttcgtcacccagaaattgaatcggcaagatgccgaggcggacaaagcggctgttaccgaattagcagcgcgcattccagcgatcatcaatagcatgaatatccgttacccagatgcccacttacgcgtggctttcgggattggctcggatgcttgggattacttattccctaacgcaccaaaaccaaaggaattggaacccttcaaggcaattccaagccctaaacatgatgccgtcgcaaccggaggcgatcttttcttccatattcgggccaaagaaatggcggtttgttatgaagtattagatcaaatgatgcaattcatttctgataacgcaacaacgattgatgaaacacacggattccgttacttcgaaggccgcgcgatcatcggcttcattgacggtacggaaaatcccgctatcgatgaaactgctgaatacgcattagtcggcgatgaagatccagaattcatcaacggttcatacgcttttgcacagaaatatatccatgccatggacagctggaaccatacttcaactgaagaacaagaaaaaacaattggccgcaaaaagttttctgacttagaacttgctgacgccgaaaagccaaccaacgcgcacaacgttgtctcacaagataacgaaggcggtgtggaacataagattgttcgcatgaacgttccatacgcaaaccctggcgaaaaaatgaccggtacttactttatcggctattctcgaacatggtcagtgacaaaacgcatgttaaccaacatgttcgtcggcaaaccagccggcaattatgaccacctactcgacttcagtgaaccaacaactggtgccctattcttcatcccatcaaaaacaacactagcaaaaatagcagaagaagaactatagagtgctgactcaaacgggttagactttgaggattaacagcattattttctgagcatccaattaaccaaattgggtgcttttcttttactttttaagcctgttaattgacttaacaaccatttgattggtacactacacttactaataataagaaaatgaggctattcatatgtcagaaacaatgcacgctgttgccatccaacaatatggtgacgaaaaccaacttgaaatgattactttaccgatgcctacaattggtgaacaccaagtcctaattcaatctaaagcgacagcaatcaacccactcgactggaaattacgtgaaggtcatctcacaagcatgttccaatgggaattcccaatcgttcttggctgggacctttccggggtcgttgttgccgttggatcagccgtaacagaatggcacgttggtgatgaagttttcgcacgacctgccacttcaaatcgtggtacttatgctgaatacgttgccgttgatgacaacttaatcgcaccaaaaccagtcaatgtcacttttgaagaagcggctgccgtcccattagctggcgaaactgcttggcaagcactctttaaccacggtcacctacaaccaggcgaaagcgtcctggtccaagctggttcaggtggcgtaggttcatatgctatccaattcgcaaaagcaatgggcgcccacgttatcaccacaactagtgcgaagaacttcgatcttgtccgtgaacttggcgctgatgaaatcattgactatcgaactgaaaaagtggccgataaagcccacaatgtcgatctcgttatcgacactatcgggggtcaaggacaagtcgatgcatgggctgtcctcaatcctgaaacaggtcgccaaatttcaatcgttggtgaagcgcctgaaactgcggccatcattaaagataccaatatgactttcaaagccatctggttaatgccagatggtgatcaacttaaaaagattgccgcattaatggccgatggtaaagtcaaatcaattatcgatactgtcttcccattttctgctgatggcttgatcaaagcccatcaactaagtgctacgaatcactcaaccgggaaagttgttattaaattctagatctcccaaaaaacaccgctaacctaataggctagcggtgtttttttaatcattgaataattgatcactttctttgtcggtacgattcccaatcgtataaatttcgaccgttacaaaaataattttgtcctgcgctttttttgttctcactcttgatacctaaataaaaatcaacctttggacctatgacaatcgactgtaaaatcggcataatagagtcatagtcaagtgaaacagtacaacgaatgatcaatggaggtcaaaacaatgaatgaacgtcaacgaattttagacttagtgaaccaaggtattttaacttcagaagaagcattagtcttattagaaaatttagccaaaaatgaccaagatgtaaaatcaaatccaactgaaacagcaacggagcaaactgaacaaccaaccgctgataaaagcgcaattgaagaaaaggcacacgaattaaccgttaacctttccggcgttaaccggcagttgcaagatttgaagcaagcaatgcacgctgatcaagaacaagtcactgtccttgatacgatggaagatttagatagtttaagcagtgaaaaagcaaccgaacggcaaacactcaaggctggcttattacaaaagcaagctgaagtcgacgagttggaagccaaacgcgaagcactgacggatgaactcaaccaaatcgaaaaagaacgccgccaaatgaccaaaaatcaatggtcagaaaaattaggcttatcagatgactggaaagaaaatgccagtgaaacatttgatgaattgagcgataagttaggcgaagctagcacacactttggtaagttcgtgaagaatactgccaaaacagtcatggataatgtggattggaaagaagtaaactttaaggtgcctggtttggcaactgaaaagttcagccatgaattcgtttattctgacgtaacaccagaaatgattaacgtcaaagtggctaacggtagtgtacatttccaaatctgggatcgtccagaagtcaaagtcgcagcgcaagtgaagttatatggtaaaatggcagaagcaacaccattggctgcttttgaagcgcgcagtacaattgatgtgactgatgccgacttggtcttccaagtgccgaataaacggattcaagcggacttaacgttctacttaccagccaataactacttacaaacgaatgtgaagttattgaacggggatgttgaattagatggctttaccggccgggatatttacttgaagacgactaacggtgaattaacgttaatcagcaccaacgctgcaatggtggaagctgaaaacgtcaacggtggcattacctttgatcaaggccgttacgatgatttactcgcaacaaccgtcaacggtaacctattgattcaagcgcaagttttaaatgcgagtgtttcaacggtcaacggggatatcaagaacactttgacgacaactgatttacaacatctaaaagcaaaatctgtgaatggcacaatcaagacagctttaccacaaactttggcaatgactgttgatgcccgcacgcgttttgggatgattaaaaatcggcttgcaaacacccaaaccatcgaacaacggcaaagtacggggaatcaaatgttacaacttggccgtaacgacaatgaacaggcagctcgtttaacattaagcacgacaactggtaatattttattgaaagacaacgataactaaaaaattaaggaatggtgggttttaacaatggggaaaagactttataaatcaagagataacaaaatgatttctggtgtaatgggcgggattgctgagtattttaatattgatgcgacattagttcgaattctatatgttgtattctcaatgttttcagcagcgttccctgggattgtggtctacatcatcttagtgatggtgattccagaacggccacgtcagagtaaacatgattctgaaagtgaatggagtgagttttaatgccttttttaatgattttattagtcattatcgccattatggcggcagttggcgtgtttagtctcgtgattggctcgctactgttattattaaaatttgcgctaccactgattgtgattgggttaattgtcagcttcatctatcgggcaattgttggtccaagtagacgtcctcggcatgcagactggcgccatgactaccaagactattcttatcaagaaacagcacatcaaggtagccgtcaacgcaaggaagcccgggatgtcaaagtagacgatgacgactggagtgatttctaatgcgttattggacacgcgtaattgttgatacgctgttattcatcgcgatttctggtctattaccaaacttgttttatgttgaaaacatttggatcgcgttagtcgccagcattgtgttatcgattttaaacatctttattaaaccattgttgagcttactctcatttccaattacgtttttaacattcggtttgtttagtgtcgtgattaacgggattatgttagaattgaccgctgttttcgtcggcgcccactttagctttacaagttttggagcagccgtgatcgtggcaatcattttatcaattgccaatacgattattacaaatcaatttgtgagagagcgttattaaaaagttagcgggactgacgtcaattaagattgacattgggcccgtttttttgtttagataagaaaacgcctacattaaagttgaaaaatcaccttaaaagcaatatgatagaggatataagtgaaaatgaaggacgggtaactcatggctgatagtgtttcaattcaaaaactagtcaccgatttaaaattacaagtttatgccggtgaagcacatttaaaaaataaagcagtgacggtgagtgatatttcccgtccaggactcgaattaacgggctactttaattactacccttacgagcgggtgcaattatttggacggacggaagtttcatttacgcaaaatatgacaccagaagaacggttaatgattatgcgtcggatggcttctgaagatacgccctgtttcttggtctcgcgccaattagaaccgccaatggaaatgcttaaagcagctgaagaagcggggattcccgtgttggggtcgaatttatcgacaacgcgtttgtcgagtttagtaaccgattatttggaagggaagctagctgaacggcgctcaatgcatggtgtgttagtcgatatttacggtttaggtgttttaattaccggcgattcaggtgttgggaagagcgaaacggcattggaattagtcaaacgggggcatcggttgattgctgatgatcgggtcgacgtttatcaacaagatgaacaaactgtggtcggtgaagcacctgcaattttgcgtcacttacttgaaattcgaggcatcgggattatcgatgtgatgaacctctttggtgctggtgcggtgcgggctgaaacgtcaatttcgttaattgtccacttgcaaaattggtcacaggataagaaatacgatcgcttaggttcagataccgaagaacaaatgattttcgacgtccctgtaccgaagattaccgtgcccgttaaagtcgggcggaacttggccatcattattgaagtggcggcaatgaacttccgggctaaatcaatgggctatgatgcaacgaagaccttcgaagccaatctaggcaagttaattgaagccaattcagatgaagaagaatagttaaaagtcagaaaagttcgttaaatatggtaggtctaatgactagtttgagctatactgttagaaagacagtatgcaaactagtcttttttagagtgcgcagtaagccgggtatatcctgaggtttaacacagaatggcgaaggattgcgtcagtaatcgtttgacattcaggggtaaccggaaggatatggcttacggagcacgtttcggataagagtgcattcaagcttgtccaacttttgcgtattagcacagtgaagcgataagcgacgcagtcgattgtttgcttcacgacgctaagcgcagaaagttagcttgaaaagtacgttttgatgaaagcacatttacaaaaggagcgaataatttgaatctactattaggcgcattaaatccgattgcattacgattgggcgcattggagatccactggtatggtgtgattatcgcaactggggtcgttttagccgttggattggcattacaggaagctaaacggcgcaatgtcagtgaagatgatattttaaatttaattttatgggcattaccatttgccttaattggggcccgactgtattacgtcgtttttgaatggtcgtattaccaagccaatcccggcgaaattattcagatttggcacggcgggatcgcgatttacggtggactgattgcagctgccattgtgttcattatctattgtcggcgtcatgcactatcgccttggttagtgttggatattgcggcaccaaccgtgatgatcgcacaagcaatcggacgttggggcaactttatgaaccaagaagcctatggggcgccaacaacattgcactttctccaatcgttacacttacctgattgggtgatccaacagatgttaattgatggtgcgtatcgtcagccgacattcttatatgaatcagcatggaatgtattagggtttattatcatcatgagcattcgccatcgaactggttggtttaaacaaggcgaaatcttatttagctatttaatttggtattcgtttggccggttcttcattgaaggcatgcggactgatagtttattcatcggtccattgcgggtatcgcagattgtctcactcgtcttattctttggtgcaattggtctttggatttggcggcgtaagcacagtcagttaccggattatttaaccggcaatcaagcaaaagaacagaaatagggatttgtttaaaaggagaattatcagatgacagtaaaaattgcagttttaggggccggttcatgggggaccatcttagcaaacttattagtggaaaatggccaccaagttgagttgtggggcaatgatcctaaaaaagtcgctgaaataaatgaacagcataccaatacacattatttaccagattttaaaattgatccccagttacacgcaacgattgatcttaacgttgcacttgaccaagttgacgttgtcttgtttgtaattccaacacaagcgattcgtgcggtggcggaacagattgttcctgtgatgattgcgaaaaaagtgaaacccgtgattgtgacggcttcaaaagggcttgaacaaggcacgcacaaacggatttcagaagtcttgacagaagccattccagaaaccaaccgcaatgggattgttgttttatcgggtcctagtcatgctgaagatgtcgcacaaaaagatattactaccttaactgccgcatcaagtgacttgattcaagcccaatggatccaagagattttcatgaatgattatttccgcttatataccaaccctgatgtggttggtgttgagatgggagctgctttgaaaaacgtcattgcacttggcgcgggcgctttaaacgggcttggttatggagataatacgaaggccgccttgatgacgcgtggcttagctgaaatttcccgcttaggcgttgccatgggggctaacccattaacctttatcggattatccggtgttggggatttaatcgtgactgggaccagtgttcactcaagaaactggcgtgcgggaaatgcacttggtaaaggtcaaaaattagctgatgtgctagccaatatggggatggtcgtcgaaggggtcgcaacatgtaaagcagcctatgaattggctcaacaacgttctgttgatatgccaatcacacgggccatctataatgtattgtatgaagattgtgatattaagactgaaattgcgtatttaatgcggcgttcaggtaaacctgaaatcgattttgatgaagtctaaaactttttaacgaataaagcggcatcattttgaatgggtatcgcacccatcatcagagtgtgttatgatgattagcgttgagaaaaaggctaaaggagaaccgattactttatgggcgatttggtatctgtaagaccaacttgtgagttttattttgacagagggatgcaggtgtttgaacgatttcagtacacgcgcgcattaacgtgtttacaacgggcaaagtcgctggctaagaccaaagatgattacatctttgtggtgtgccaattagcgatttgtttggaatcggttggcgactatcatggtgcggcgaccgttctggaagaaattccaaccgccaactatcagagtcatcctgagttacaatattttttagcaacagcgtatgcctttttaaatcagacgcaggcgagctacgaactcgcgactgcttatttacaaagtgacgattcggattttgatgccgaagccactgaattactacaggaattaaaactaacaagtccatcaaactggtaaaacagtttggtagacttttttttacataacgggtaagatacgttttaagaagaacgagtacttttcaaaagtaaggagataacagacatggctaaaagttatgatgtaattgtgattggcgcaggacctggtgggatgaccgctgctttatacgcttcacgtgcgaatttatcagtattaatgttggaccgcgggatttacggtggccaaatgaataatacggcagaggtcgaaaattatcccggctttaaatcaatccttggccctgaactaggcgaaaagatgtatgccagcgctactcaatttggtgctgaatatggctatggcacggttaactcgattgaactgcaaggcgagatgaaactcgtgcacacggatgaaggcgactttgaagcgcgctcaatcatcattgcaacgggttcagaacacaagaagattggcattcccggcgaagatgaattcggcggccgtggtgtctcatactgtgcggtctgtgatggtgccttctttaagaataaagaagtcgtggtcattggtgggggcgattcagcgattgaagaaggcctctacttgacgcaattagccagcaaggtgacagtcattcatcgtcgtgatgaactacgcgctcaaaagattttacaagatcgtgcatttgctaacgacaagatggacttcatctggaatgcacaagtgacaactattgaaggtgacgacaagaaggtgacaggtgtcacttacattgataaggcaactggtgaaaccaaagaagttgctgcaagtggggtcttcatctatgtagggattgaaccaatgactagtgcctttggtgatctagggattctaacggatgccggttggattaaaacggatgaccacatggcaaccagtgttccaggcatctacgcaatcggcgacgtccgcgaaaaagatttacggcaaatcacaacggcagtcggagacggtggcatagcaggccaagaagtatttaaatatttacaaagtatctagagtgcgacggcagccggttagcttccgaggattaacacagaaaagacagttcgaggaagcacgattagagtgcgttcgaaacgattttatttttgaggattaacctaaaaatgtggcttatgacgcacatttccagcggtcgactaaattgtagtcggccgtttttttattttgggaaaaattttaatttttagaaggacaagcattattaaataatcgacccagacaattagcttggtgcgcattaccgtacaaccgatgctttaggaaagcggttgattatggtatacttagaactagcttttagactaaaatgcgggggttacacaatgagctggcaagataattatgcaatttggaataatcaaacagaaatggatttacctttaaaaaaagcacttaacgaaatggcaaacgaccatgatgcattagaaaaagcatttagcgttccaatggaatttgggacagctgggatgcgtggtattttaggccctgggatcaactgcatgaatatttatacggtgcgtcaagccacagaaggcctcgctcaattcatggaaacattaccagaagcgactaaaaaacgcggtgtggctatcagttttgattcacgttatcaatctgaaacatttgcgcacgaagcagcacgggtcttaggtcaacatcaaatcccaacgtttgtttttgatgccttacgcccaacacctgaattatcatttaccgtacggcacttacatacctatgccggtatcatgattacagcaagtcataatcctaaacaatacaatggttacaagatttatggcgaagacggcgcacaaatgccacctaaggaatccgatttaatcacaagttatatccgcaaagtaaccgatttatttgcgattgaagtggctgatgaaagcacattgcgcgaagccggcttaatgactttgattggcgaaaatgtggatcaagcttacttagctgaagttaagcaagtcacgattaatcaagaattggtcgacacagtcggcaagaccatgtcattgatttacacgccacttcatgggaccgggaaagtgcttggtgaacgcgcattgcgtcaagcaggctttgaacaatttacaatggtcgctgaacaagccgttgctgatccagaatttgcaacgacaccattccccaatccagaattcccacaaacattcgatatggcgattgaactcgggaaagcacaacaagctgacttgttgattgcgactgatccagatgctgaccgtttgggcgccgctgtgcgtcaaccagacgggagttaccaattgatgactgggaaccaaatcgcttctgttttattacgttatattttacaagctagtaaagatgctggcacattaccagccaatgcagcggctgttaagtcaatcgtgtcaacagaattggcaacgaagattgcagcgagctacaatgtgaagatgattgatgtcttaaccggcttcaaatttatcgctgaacaaattcaacactttgaagacacagacgaaaacaccttcatgtttggtttcgaagaaagctatggctacttagtgaaaccattcgttcgcgataaagatgcgattcaaacattggtcttattagcggaagttgcagcttattacaagtcaaacggtaagactttgtatgatggcattcaagaattatatgcggaatacggctacttcgctgaacaaacgactgcagttgatttcgaaggggtcaatggcccacaacaaatggctgacttgatggttaaatgtcgtgaagaaagcccagttgaatttgccggcatcaaagtcgcttcagcagaagacttccaaacacaaacagaaacttttgcggacggtcatactgaacccatcaatttaccaacatctaatgttctgaaatatcacttagaagatggcacttggattgcgattcgcccaagtgggactgaaccaaaagtgaaattctatgtggggacatccgctgatgatgccgcaacagctgatttgaagttagcaaacttcgaaaaagcaattcatgaacttgtaaaatagatagggcttctgttttacatttcaggataacttacctataataaagaacagcaaatagacggactactgcgttagtcggtctatttttgtaagaaaagggaggtagtttggtatgggtatgcatcaatatttgcaaggtttgaataatttggagacactaaatcgcgcaccaggattgtttaaatatcaagaacattccgttgcagcgcactcctttaaagtagcagaaattgcgcaattattaggcgatattgaagaagaaaatgggcaaacgattaattggcaagtgctgtacgaacgcgcactgaaccacgattatacggaacggtttatcggcgatattaagacgccggtcaaatacgcaacgcatgaattgcggacgatgttggccaatgtcgaaagttcattaaccgctaacttcattaaaaatgaaattccagatttcttacaagaacggtatcaacgtcgtttgagtgaaggaaaagatgaaactttggaagggcaattattagccgttgccgataagattgatttactctacgagtcttttggtgaaattgaaaaaggtaatcctgagaatgcttttctagaaatttttgcggaaagtttaaaaacgattatgcaataccaaaatctcgcatgcgcccgttatttcatccaagaaatcttgccagatttactgagtgaagacttcgcagatcgagggaagctaacccaattagtgagacagacgctagcggaatagagtgccgttgtcagtcgctcagattcagagcatttgcctaacttggcgaattgacgctataagcggcgatttgacaagtgtagcaaagcgcaggaatctactgacaacagcacgtttccacactttagttgaaacgtgctttcattaagcatccttttccggttagctacaccagccgcatcatcgactgcgtcgctaatccgtctggttaggctaatcctcaaaggataaccgcttaatgacgcactctttaatcagcactctggcgaaagtatgttcggtgtggtagaatagtgaatgacttaaaggacaaggaatattattctttataaaatcggtaagtagacgttatggtggagggcaacttctacccggcgtcttcttttatcgctagcaaatggtaatggaggcttttgatgattgaacgacagaatgataaccaatttgatttagtggcgccctatgaaccagctggggaccaaccagcggcaattgaaacgttaactaagaacttcgaggcgggtgcaaaagcacaagtcttgatgggggcgactgggaccgggaagacctttacgatgtcgaacgtcatcaagaatttaaacaaaccaacattgatcatttcgcataataagactttggcaggccagctctatgccgagtttaagcaatttttcccgaataacgcggtagaatattttgtcagttactacgattattaccaaccagaagcttatgtgccttcaagtgatacctacatcgaaaaagattcgagtattaacgacgaaatcgacaaactacggcattcagcaaccagtgcgctgttggaacgcaacgatgtgattgtggttgcgtcggtttcatgtattttcggcttaggtgatccgaatgaatatcaagatcacgtcctttcgttacggccagggatggagattgagcgcaatgacttattgcgtcaattggtggatattcaatttgaacggaacgacattgatttccaacggggccgtttccgcgtccgtggtgacgtggtcgagattttcccggcttcacgtgatgatcatgcgttgcgggttgaattcttcggcgatgagattgatcgaatcgttgaagttgacgcgctaaccggtgaagtcattggtgaacgcgaacatgttgcgattttcccagcaacgcatttcatgactagtgaagaaaagatggaaaaagccattaagagtatcaaggctgaattagaaggccgactaacggaattgaaggcggacggcaagttgttggaagcccaacgtttggaacaacgaacgaattacgatcttgagatgatgcaagaaatgggctattgctcggggatcgaaaactattcacggcacatggaggatcgtgcggcgggggaaccaccttatacgttgctcgatttcttcccgaaagattcaatcatgatgattgatgaatcccatgtaacgatgccgcaaattcgcgggatgtataacggggatcgtgcccggaagcaaatgttaatcgattatgggttccgattaccaagtgcgcttgataatcggcctttgacgctacctgaattcgaagaacacgtcaatgaaatcatgtacgtttctgcgactccaggcccttatgaagctgaacaaaccgatattcaggtcgatcagattattcgaccaactggcttgttagatccgaatattgaggtccggccgattatgggccagattgatgatttggtcggcgaaattaatgatcggattgaaaagaacgaacgtgtctttattacaacgttaaccaagaagatggcggaagatttaactgactatctcaaagaactggggattaaagtccgttacttgcatagtgatatcaagactttggaacgaacggaaattatccgtgatttacggcttggtaagtttgacgtcttaattgggattaacttgttgcgggaagggattgacgtccctgaagtctcgttagtggcgattttggatgccgataaagaaggtttcttgcggagcgagcgctcattgattcaaacaatcggccgtgcttctcggaatcaaaacgggcaagtccttttgtatgccgataagattaccgattcgatgcgcaatgcaatggatgaaaccaagcggcggcgttcgattcaagaagcctacaacgaagcacatcacatgacgccgaagacgattatcaaaccagttcgggatgcgatttcggttgttcaatcagtcgaacaccctgaagaagtcaagatgaccaacgagattgatttcgatagtatgtcgaaagctgaaaaactagaaatggtagaacggttatctgaacaaatgcggaatgcggccaagaaactggacttcgaacaggcagctacgttacgggataccatcttagagattaagagtgaaattgattaaaagaggtaaagcatggcaaatgataagatcgtcattcatggcgcaagagcgcataatttaaaggatattgatgtcacgattccccgcgataaattggtggtagtgacaggactatcgggctctggaaagagttcgttggcgtttgatacattatatgccgaaggacaacggcgctacgtcgaaagtttatcggcttatgcgcgccaattcttaggccagatggataaaccggacgttgattcaattgatgggcttagtcctgcgatttcgatcgaccaaaaaacaacgtctaagaatccgcgttcgacagtcgggacagtcacggaaattaatgattatatccggcttttatgggcgcgggtcggtcatccaatctgtccaaacgatgggactgaaattagtagtcaatccgttgaacagatggttgatcgtgtcttagcgttacctgagaagacgaaactccaggtgatgtcaccgattattcgtggcaaaaaagggcaacataaaaaagtatttgaaaaaatccaacgagaaggctatgtccgcgttcaagtcgatggtgaagtcatggacgttagtgccgatatcgaattggataagaataaaaaacacgacattaatatcgtggtggatcgaatcgtcgtcaaagacggtgtccggtcccgtttatttgactcgttcgaagcggctctgcgcttatcagaagggtatgcgactgccgatatcatcggtggcgaacaactacttttctcagaacactatgcctgcccaatctgtggctttacggtgggcgcgttagaaccccgcttgttctcgttcaacgcaccgtttggggcctgcccagactgtgatggtttaggggttaagctagaagtcgatatggatttagtgattcctgataccagcaagacattgcgcgaaggagccattgcgccttggaatccaattagctctcaatattatccacagatgctcgaacaagcttgcaagtcatttaaaattgacatggatcgaccatttagcaaattaacaccacgccaaaaagacattatcttaaatggttctcagggtaagaacttccacttccattatgaaaatgatttcggtggtgtgcgtgatgtggacgtgccgtttgaaggtgtattagccaatattgaccgccgttatcgtgaaaccaatagtgatttcacacggacgcaaatgcggacgtatatgactgaattaacgtgtcaaacctgtcatggggctcgtttaaatcgacaagctttggctgttaaagtgggcggccaagatatcgctgccgtttcagacaacgccatcaaagaagctttaccattcttcgatcaacttgaactttctgaaaaagacagtgtggttgccaaaccaatcttgaaagaagtgcatgatcggttaactttcttgattaacgtcggtctggattatttaacgctcagtcggtcagccgggaccctttctggtggggaagcccaacggattcgtttagccacgcaaattggttcgaacttatctggcgtgctctacatcctcgatgaaccgtcaattggtttgcatcaacgtgataatgaccgtttgatcgggtcactgaagaagatgcgcgacttaggcaatacattaattgttgttgaacatgatgaagatacaatgcgcgcggctgattacctgatcgatatcgggcccggcgctggtgaactcggtggtgaagtgatggccgctgggaccccaactgaagtcgaacataatccgaaatcgttgacgggccgttatttagccggttccgaatatattccagtaccgctagaacggcgtcaaggcaatggcaagaagattcgcgtgaccggtgcggctgaaaataacttgaagaatctgacggttgatttcccattaggtgaatttgtcgcggttactggtgtttcaggttcaggtaagtcaaccttagtcaatacgattttgaaaaaagctttggcacaaaagatgaaccgtaactcagcaaaaccaggtcaatataaaacaattacaggttatcagaatcttgaaaaactgattaatattgatcaaagtccaattggtcggacaccgcggagtaatccagcaacgtacaccggcgtctttgacaatattcgtgatttgtttgcgcaaaccaatgaagccaaactacgcggttataaaaaaggccgttttagttttaacgttaaaggtggccgctgtgaagcctgcaagggtgacggcattatcaagattgaaatgaatttcttaccagacgtgtatgtgccgtgtgaagtctgtcatggcagtcgctataattcagaaaccttggaagtcgtctataagggcaagaacattgccgaaatcttagacatgacggtcggtgaagccacagtcttcttcgcaaacattcccaagattgcccgcaagttacaaacgattgtggatgtcggcttaggctacgtcacattgggccagtctgccacaaccttatcgggtggagaagcccaacggatgaagttggcctctgaattacagaaacaatcaacgggtaagaatttatacatcctcgatgaaccaacgactggcttgcataccgacgatatcaagcgcttgttgggcgttttggaacggttagttgaagaaggtaacacgatcttagtgattgaacataacttagatgttattaagactgccgatcacatcattgacttaggaccagaaggcggcgataaaggcgggacaattgtcgcgaccggtacgccagaagaaattgccaacgtcagtgaaagctatacaggccaatatttaaaacctgttttagaacgcgatacagcacgcacaattgccgctcaggattaaccagaagatggttgatagaatgtgtttaaaaagcgggcggttaagacagaatgattgctgtcttaaccgcccactttttgttttgtcaaatttagttgtagattgtccgaaaaaaaagtatcataaaggtattaacaacgagaggtgattgggaatgtttagaaaaaatgaatggcactttgattggtcagaatttatgacggggattattttcttaatcgttgcatattgcttgtttaatcaaccaggtaagacattatctggtttggtaatcgtgattgcgattgcggcgattattcggggaattgccaaaatcagtgcatatagtcggttacgtcaagagacagggatgcgcgcaacgttaatgttggtcgatgccattgtcgatgtcattttgggaattttgtttatcttgaatattccagctggagtggctgctttaggttatatctttgcattctggttcttgttcgattcaattgtggcattattgaatgtcggccatctcaagcaatttaacacaggtctatacatcgtttcgatgattctgaatatcttaggcgtaatcgttgggatcttattgttaatggatccagtggtgactgccgtaacgatggtgaccctagttggtttttactttgctttctttgggattaatgccatcatcatcgcatttgcaagacgtttatagtctctaaatttaatgattgcggaacaatttgattgttctgcaattttttttatggaaaaaataagctctttcaaatgcctagacattaggaatgaactcggtttaatagcattaaataacacgtgtcgagagtttcgacagctttcaatgacacaccaggaatgttacaatgataaaagcgaaaacttaaggggtggtctgatgacagatacattgaacttagtagtgattacagggatgagtggtgccgggaaaaccgttgccatgcaaagttttgaagatctaggttatttttgtgtcgacaatatgccaccgacattgctacctaagttttgggaattggttaaggagtccggcaaagtgactaagattgcattagtgattgatttgcgctcacgtgctttttacgatgagatcattgaaatgcttgctagccttgataatacccaattcgtgacgactaagattctcttcttggatgcatcagatgaggaattggtttcgcgatacaaggaaacacgccgttcccacccactagcgatggaggggcgtttaatggacggtattcaaaaagaacggcgcctgttaactgaaattcgcaatcgagcacagatggtggtggatacttcaaccatgtcaccacgacaattaagagaaaagatttttcatgtcttcaagacgtcagataatccgtcattccatattgaagtgatgtcatttggatttaaatacggtttaccaattgatgcggatatcgttatggatgtccgtttcttaccgaacccatactatgtgccagaatttaaggaattaaacggtttagaccaaccggttagagactatgtaatggcgcagccagcgactgaaaagttctacgaacaatttagtgggctgttaaaagacatcatgccaggttatctcaaggaaggcaaaacaagtgtgacaattgcgattggctgtaccggcgggcaacaccgttcagtagcgcttgcccaacgattggctgatgatttatcgttcgattatccggttgacgtgacccaccgggatatgaagaaacgcaaggaaacggttaaccggtcatgacagctactaatcggattatccgggtcattaaagggcgacgaccaaaagtcgttgtgattggtggcggcactggactacccgttatcttaaagagtctccgtgaacagaatgcggatgctacggcaattgtcacggttgccgacgatggcggttcatccggcgttattcgcgattacattaacgtggtaccacctggtgatattcggaatgtattagtcgccttgtcagatttaccacagttaacgctcgatattttccaataccgctttaaatcacacgatgcctttttctcagggcatgcgattggtaatttaattattgcggcgttatctgaaatggaatcaggtatttttgatgctgttcaacggttatcagaaatgatggcggttgacggtcatatttatcctgcggccaatgttgcgctgtcgttgaatgctgaatttaaagacggcacccagttaacaggggaatctgagattactgcagcacgcaagcagattaagcgtgtttgggtctcaaaaacggatcaagatgatactgcagcacccgaagccgttcaacaagtggttgatgcgattttggctgccgatgtggttgtcttaggacccggcagtttgtttaccagtattttaccgaatctaatgattaaaaacttaggtgcggcagtcaagcaaactaaggcggaagtgatttacatttgtaatatcatgacgcaaaaaggggaaacggaacactttaccgatgccgatcacgtccgcgtgttgaatgatcatcttggtcagaacttcgtggacacggttttggttaataccgcacaagtccctgaaaactatttggatcatcaaaagtacgacgaaattctctggccggttgaacatgattttgatggcttacgaggattgggttgtcgagtgatttccgataactttttgaagttgaaagatcatggtgtgttccataatggacaaaaagtagcgagtgaaattatgaatcttgctttccaggtcaatacagctaagcgaggtgaataatcgtggcctcatatgcaagtgaagtgaagaaagaactgacgcaacttgaagtgcatcctgaacatgcacgagcggaattagccgctttaattcggatgaatgggtcactgagcttgatgaatcaccaatttgttttaaacgttcaaactgagaatccggcgattgctcgccggatttatagtttattgaaacaaaattatcaagttgaatccgaattactagtacgtcgcaaaatgaagttaaaaaagaataatcaatacatcgtgcgcttaaagtatgataccaataccgttttaaaagaccttgatattgttgaggaggacggttttaccattcatacaaaggtgtcagaagatgtcattaatgaagatcagcgcgtccgttcttatttgcggggcgcttttctagccggtggctcagtgaataatcctgaaacaagccggtaccatctggaaatctattcattgtacgaagagcataatcaagatattgcgcgcatgatgaatcgttttggcttaaatgccaaaacgactttccgacggagtgggtacatcacttatctgaaagaggctgaaaaaattgctgattttctacaagtgattggtgctaccaacgcgatgttgaagtttgaagacattcggattgtgcgggatatgcgtaattcggttaatcgcttagtcaattgtgaaaccgcaaatatgaataagacaattgatgctgctacaaaacaaatcgaaaatatcgaatacttgcgcgacaccgtcggactagataatttaccggcgaagttgcgtgagattgcgctactccgtttggaatttccagatattacgttgaaggaacttgggaaaaaaatgccgagtggggcaatttcgaagtcggggattaatcaccggctcagaaaattgaatcaacttgccgaagcccaccaacaggggaatggataaggggcaaaataaataggtagtgcacaatatttgacttgtacaatataattaagtacaatacctgaaggacattttatggagggaaattatatggttaaaccagtattattagatgaacaactctgtttttcgatttaccgcgcacaaaaggcttacaatcacttctacggtaaggtattaaaaccttacggattaacatatccacaattcatcgcaatgcttgcattgtgggaacatggcaagatgtcagtgaaagaattagggcaccatttagaacttgatagtgggacactaacaccgcttttgaaacggttagaagctgatggttgggtaagccggaatcgtgcatcagacgatgaacgccgagttgacgttaccttaactgaaaaagcagaaagtcaaaaagaagaaatctacgaacgggttggtgcttgcacaaactatctcgatttatcaagcgataagtatcatgaattacgtcaagaaatgaatgaagttgaacatcatttgaatgcgattcaaatggataatgcacgtttttcataaaatgacggataaagggttccaaaagatttgatggtaaattgaattttttggaaccctttatcgtacatacaaaaacaggtgccccgagggggggcacctgttttttattttagtagttgacttaagtcagtcatatcaattgattcatcaaagatatggtcaccaataatgatggtcgggacgaatttaatattggcacgatcggcttcagcaataattgcggctaaattttctgcattatcttgtggcgttaatttgagattttgatcgatgtattttttaaattcatctggtgtcagatcattacgccatgttttttgatgcgtaaacaagaatgatagtgtttgcagcactatttcgggttgatcaaagacgaacaatttaatgttcgccactctttcactaatttagtttaaattttaaggaaacgacgcattgagatgacagaacctaatgccccaatcacaatcccaatcacagccattgttaaatcaagttggaataagaaaattcctggtttcaacattgaataaccggctgaagccatgctgagtgccatatgacggtaaacccaaccataacctaagtcgattacaataatgggaataattaccccaagtaatccaacccaagccccttcaaaaaggaatggccagcgaatatacgcgttagttgccccaactaaacgcataattccgatttcgtcgcgccgcgataaaatcgtaatccgaattgtattggaaatcaagaacactgccacaaagagcaataataaagtaaaaccaacgccccatttacggacgctactcattaccttgaacaacttcttagcgttgttcccaccataagtggcatcataaacgtatttcaattttttcgcttgtttagcgactttaatcgtttgacttggttttgtcgtacttactgtgtaaacatcgtacaacggattatcgtctccggtaaacatcttaaatgattgaccgtaactgccgacaaccttgtttaattcctttttacgacttgaatacgtcacttctttaacagacgccattttttcaagtttcttttgtagctgatctttttgtttacttgttgtgccccgttcaatcataacccgcacgtgcacatcattttcaatatcttgtgaaatcttgttaaagttgaagatcatcgcaaagaaaatcccgactaacaacaacgttacggtgactgcactaacagctgcgattgacatccagccatttcgttttaaactcttaaaactatcgttgagatgacgcttcaatgttctaatcttcatagccgtagtcaccttctttttcatcacgaactaagcgaccgtcttcaatcgctaagacacgatgggtccgttcgttcaccatttgtttgttatgggttgccattaagacaatcgtcccacgttcattaattgcttctaaaatatccataataccatctgacgtttcaggatctagattccccgttggttcatcggcaatcaacacatctggccggttcacaatcgcacgtgcaaccgcgacccgttgttgttccccaccagaaagttcatttggaaagcgacgaatttcacccttcaagccaactagttcgagcacttctaatacacgatctttgattgcttcaggttctgcctcgatcacttccatggcgtatgccacgttttcaaacaccgttaaacgtggtaataacttgaaatcttggaaaacaacacccatcttacggcgtaagtatgggacatcgtgatccttcataccgattaaatcaaaaccagcgacttcgatttcaccactcgttgcttttaattgatggtacaacatcttaatgaatgttgatttaccagcaccactgggaccaacaatataagcaaattcgccgggttcaatcgttagcgaaagatccttaattgctgtcacgccatttggatacttttttgacacatttgtcattcgaatcaattggggacactcctttttttgtcgttatcattatttattgtcaatgaaaaccgcaatcttttatattatagcatgctatttattcaaataatcacaatttgattacatttatatttcaatttctttgcagctagtcgggattcttctgactcaactgccattgcagataggcatacataaatggatccaaatcgccatccatgactgcttgcccgtttccggtttcgtagtcggtccggtggtctttaaccatcgtgtacggatggaatacgtatgagcgaatctgtgagccccagccaatttcaagctgttcgcccttaatagcagccgcttttttcgcctgttcttcttgttctttttgatacaatttagccttcaacatattcatcgcagtttcgcggttttgcaattgcgaccgttgcgcctgtgatgaaacaacaatcccagttggtaaatgcgttaaccgcacggctgatgatgttttattgatatgttgcccaccagccccgcttgaacggaagacgtcaattcgtaagtcttcggtgcggacttcgatatcaatcgaatcatccaattccggcatcacatcgactgaacaaaacgaggtgtggcggcgcccagctgaatcaaacggtgaaattcgtacaagccgatggacccctttttcagaacgtaacatgccatacgcgttgtgccctttaatcatcaaggtcacactcttaatcccagcttcttcaccggcctggtaatcttctgtttcaacggtaaagccgtgtgcatctgcccagcgtaagtacatccgcaaaagcattgaaccccaatcctgagattccgtaccaccagcaccaggatgcaattcaacaatcgcgttattgctatcgtagtcgcccgatagtaattgtccgagttcatattgttgcatctgagcttgaacagccgtcaaatcagcttcaaaactcgtctggagttcagcatcgggttcttcttgtaatagctctaatgtcacttgtagctcttctgattgcgcttgaagttgcataaaagagtcgtatttttcctttatggcgttattttgatcaattaactgttgggctgctttttgatccgaccagaaatcgggatccgccatttgcgcttcattttgcgcgatgctttcttgcaggccatctaagtcaaagtgaccccctaaattgcgttattttagcttcaattgcttctaaaagatgttttgcttcacttaattccatattttagtccctccactattttttcccattaaaaaatggctaagttaactacctcagccattttctacgcgttagcgtcgaatattttgacggatttccgccttcatgaagagccgggttgtatcgtaatcgatgtcgctgatcatttcttcaaacatccggtaaccttcttcttgatattcaaccaatggattcatttgaccgtagccccgtaatccgattgagttgcgtaattgatccattgcatcgatatgatcggtccagcgttcatctaccacacggaggataacgactttttcgaattcgagcatttgatctgcatctgctaattgtttttgttttgttgcgtaattcttttctgcaaaggccatcaataatgattcgatttcttcagcagtcttaccttgtaatttttcaattggtaattcttcttcaccgaccattgaagttgtggcaaatgcgtggattgcttctaattcccagctccccatttcaccttgtgtatgcaattgcacaatccgtttaacggttcttgaaatcattggcatgataacttctttcaaattatcttctgccatgatgacctgcatccgttgtttatagatgacttcacgttgttcacgcatcacatcatcgtattgaagggtttgtttacgtgtatcgtagttattcccttcaacccgtttttgtgcggcttcaacttgacgcgtaatcatcttactttggatcaccgcatcgtcatctgaaatcttcatccggtctaggaaggctttaatccgttctgaaccgaaacgtttcatcaagtcatcttccaatgacatgtagaattgtgtgacaccaggatccccttgacgaccagcacggcctcgaagttggttatcaatccggcgtgattcatgacgttcagtcccaataacagccaaaccgcctaaatccgtcacaccaggtcctaatttaatatcagtcccacgaccagccatattagtagcgatagtgaccgcaccacgttgaccagcattcatgataatttcagcttctttaaagtgattcttagcattcaaaacagcgtgtggcacgttattttcatctagtaatcgcgatagtaattctgaagattcaaccgcaacggtcccaaccaatactggttggcccttagtataacgttccttgatatcttcaataaccgccttaaatttactttccaaagttggataaagcacatctggtttatcgattcgggcaattgggcggttagttggaattgagataacttccatgttgtaaatttcgcggaattcttcttcttcggtcttcgccgtcccagtcatccctgataacttgttgtacattctaaaataattttggtatgtgatattcgccattgttttggtttcatcttggatttcaacgccttctttggcttcaatcgcttgatgtaatccatctgaataacgacgaccatccatcacacgacctgtaaattggtcaacaattaggacttcgccttcttgaaccacataatcaatgtcttttaacatgatatagttggcccgtaatgattcgtccaaatgatgcgtcaaggctgtattttcagtgtcatataaattgtccaagccgaagttagcctcagctttttcaatccctgattctgttagactgatggtctttgttggccaatcaatcttatagtcagtttcttcttttaaagttttaacaaaacgatcagcacggatataaagtgctgttgacttttcagcttgaccagaaataatcaatggtgtccgcgcttcatcaattaaaattgaatccacttcatcgacaatggcaaagttcaatggtcgttgaaccatttcttctttgtaaaccaccatgttatcgcgcaagtaatcaaacccaagttcactattcgttgaataagtgatatctgagttgtatgcgtcgcgtttttcttctggtgtcttagcatttaagtttaacccaacagaaagaccgagccagttatataattcacccatttccgttgcatcacgacttgaaaggtattcgttgacggtaacaacgtgaacgcctttaccagccaatgcatttaaataaacaggcatggtagccgttaaggttttcccttcaccagttttcatttcagcgatgttaccttcgtgtagcgtaatcccaccaataatttgtactcggaacgggaataaccctaaaacacgtttagcaccttcacgcgcaaccgcaaaagcttctggtaaaatatcgtctaatgtttcaccatttgctaatcttgttttgaattctggggtcttagcttgcaacgcttcatcagataaattactatattcatcttcatagctttgaacttgatcggcaattttgcccattcgcgctacttcacgtttatcgctttctacccatgtttttagaaagtttgccatgtgcgtcaattctcctctagaaatacgtttgagttcttaaatagcgatttcttatatagtcaatatgattactaacaattcattttaccatttattacaatcaaataaaaccctgtcacagtaaacaatccagccaattcagtaaaaatttaaccccattatctatatggctacaaaaaaagggctgagcgcaactcatcgttgtcccagccctaacttaacgttcacttattcatcagtttcaatcaaaccgtaacgaccatcttgacgtttataaacaatgcttgtaccgtttgtttctgaatcttcgaagatgaagaactcatggcctagcatattcatttgtaagattgcttcttcactatccattggtttcaatgaaacgcgttttgttcgaacgacttgcattgattcttctggtaatgcttctgcttctggcaccgttaattccatacctttaatcccgcgttcacgtgatttacggttaatctttgttttaaatttacgaatttgtctttctaatttatcagtaactaggtcgacgctaccatacatatcaggcgatgtttcttctgctcttaatacaaggtatggtaatggaatggtgacttccaccttagcggttttatcggagtacacttttaaattaacgtgtgcagttgcggtcgctgaatcatcgaaatatttttcgagtttgctgattttcttttcaacataactccgaattgcgtcagttacctcaatattttcaccacgaacattaaaacttagcatatgaattctcccctttcacaaataccccctgtgggcacttgtcgctcggaactcaattctttcccgaggctttgttactgacttcattatatataatttgcgcgtaacacacaaataatatggtcctagtggactaaagtaattgcgtgaattggcagcgtttggtatcgcttgcggagacactgctgagcatgccataacgtgcgcccagtggtataaatatcatccaacaaaattaactgctgcaccttggaactcaacagcacgttctgcgcgcatttaaaaaattgcggcgttgctaagcgctctgcacgatttttttgtgcttgtcctttttcagttggtagcttctgcaacaatggggtcagtggaaaacagtcctcgtataagccaaccaccggattgaatccgcggctttgcaaatgtgttggatcagtcgggactgggatatacgccgtttgccgttgcacaggaaaattttctcgaatcagccgttgaaatacgtgacgtaatcgataatccccctgccccttatagcgttgaaaatactgttgcattggttcgttgtatgttaacaatgctcgattagtaaattgttcgcctggatacagttgctgccatctctggcaatccggacacaccccctgggttgtcatttgccgaccacatcccgaacaacactgcggcccaatccgttcaaactgtgccatgcaacgtgaacagatcatcgccggatagactggtcgcaatgaacaaatcaatgcaatggagggttgttcaaggataactgccgcacacattaaacagtggattgtaatcgccgtccttttcgattttgtcgtttaatttgttgacacgcacgctgaatagcgaccgtgtaatccgcgtagaaaaaataaaccggattggcagcatgctcttgctgtcgtccggctcggccagcaatctgtacaagcactgattcagtgaagaccacgtgttctgcaccaagaacaaacactgcaatatttttaaacgttacgcctcgttctagaactgtcgtcgtaatcagcacgtccccgcatcctgctctaaaggccgctatcttgtctaattgattaggatcgccagcatgtaccgtgttcactgtaatgtgtggcaatgcccgaacaacgctctgctgaaccgcctctaaatcccttacctgtggcacaaataataataagcgttgttcttgaagacacttcctgagtaagttgcgcatcacggatggtaactgatgccgtttaactgaacgccgccacgtaaacaagggatagcaatgcggttcaggtaataagtgaccatgaaagcgaattggtagctcactacccgttaaatcccctgtattaatcgcatggcgcaactttacagttggtgtcgccgtcagatagatcaatgcacagcatggcttacacgcctgtttaacagccatctcaagctggggattattgacaaatgggaacgcatcaacctcatcgacaatgacagtgtcaaatgcctgataaaacttaaataactgatgggttgtacaaacaactaacggcgtataccggtaaggcgcagtctgttccccatgcatcagcatgattggtgtgttagcaaacgctgcttgcaagcgcggatagagttctaaacaaaccgccacccgcggcgcagcaacacacacacgctgcccattagctaaagccgtcgcaatgccttgaaataacatctcagttttaccagcaccggtcactgcagttaagacatggcgttgttgcttggtaatgaccgcaacaatctgctttgcggcttgtgcttgaaaaggggttagtgtccccgaccaagttagcggttctacgatcgactcaaacagattgcattcaggcacgtaaaccaactgatccccttccactaaccgcccaaaggtcaagcaagcagcacaataataccgaccatcaggtaagcgagcttgctctttcaccacttgtccacaccgttgacataccagacgctgattaactatttgaaacgctagtcgctgtttaatctgtggtaaactataattattcataacggtactcaattgggtggcactccactgacgaccataagcaagttgttttgccatcatttcaccttccacccttagttccgttaaatccagcttattttttcaaggagtccggtatgcaaagttattttaccgttcaaaaagacggcgaatttgaactcgaaatcaaaaagtcacgcttcatctgtcatgttgcgcgtgtcacagacgaaaccgcagcacaagcgttcatcgcacaagttcgcaaagcaaatctgaaggccaatcataattgtttcgcctaccaattaggtttaacggccaatattcaaaaacaaagtgacgatggcgagccaagtggcacagccggcgtgccaatgttagaagtactgcgccagatgcagctcactaatctgtgtgtcgttgtcacccgctattttggtggcatcaaacttggtactggtggtcttattcgagcatacagtcacgccacttcggccggacttgaacacctcggtattgtccaaggtatcgaacaaaccgcttgtcagattacaattgactacgctcaatttgacactgtgcaaaatttacttagccaattaaacctcactgccgaagacatccaatatacgactaacattcaaatgaccgtctggttagcgactacagcagttagtgatttacaacaacaattaaccgaacgcctcaacggccaattacaattcgaccttggccctcaacaattcaacgaagtccccattagcgcacaggatttacaccagattcgctaccaataacgcaagaaaaggattagccaatggctaatccttttcttcattcttcggttttaataatcgttttaaaagcatcaataatgggcggcgattgtcaccaagtaacccaattgattcaacaaataattctaagccaattaagacggctaccgtcaatgccaagcttccccagagtgtcgatagtgggtagagcaatgaaatcaacgagaagaccaatgccagtccataaatcacgagaaccgtttggcgatgtgataaaccaagttgcatcaaacgatggtgtaaatgatgtttatctgcttgtgaaatgggctttttattcaaaattcggcgcaacattgcgtaaattgtatccgtaattggtacaccgagaataataactggaatcaataacgtaatgaacgtcacgttttttaaacctttgagcgataagaccgcaatcataaaaccaatgaataaggccccggtatcccccaagaaaatcttcgctggatggaagttatgtggtaagaaaccgattaatgcagcgaccaaacaaaaaatcatgattgagacgctgacattggtgattgataagaagaaataggcgatgacgcccattgtgaagagtgcgataatcgaaacgccagttgctaagccatccaacccatcaatcagattaacggcgttggtaattgccagaatccaaaaaatggtgattgggaagcttaaccatcctagttcaaaggtgcctaaaaatggaattgtcaaaatattcatgcggacgcccgctaagaaataaatgaccaatgccgctaataaaataccgagcatcttttcctttggattcaattccttaatatcatcgatcatcccagtgatgatgatgatacattctgctaagaagatactgaaaagttcgtgtgtttggaattgcccgcgtaataatacgaaggtcccaaacgtaaacgcgataaaaatggccagaccacccattgccggcatcgcctttttattcactcggcgggcatttggtttatcaactgcgcctaaaacaaacgcgaggcggcgcactaatggggtaattgcggccgatacgagcatcgtcgcaaatagaccaactataattttaaacatgggttgcattcaacttgcctactttctcttgcattctctttattatacaaatcaaacccgttaaacacaacaatgacttgatttcttaagcaaaagccaagcaccctgattatctgtcccgcacaatctgggctaataaggccgtaaatcgtggatcagcattaaagggatgaatgtaatcaaattgttcgccttgattatccataaaatagtcccgattttcaacatcaatctcttcgatagtttccaaacaatccgcaacaaagcccggggttaggaccaaaatttttctaacgccttcttgggctaatgactgcatcgtagtgctagtggccggtgttagccattcattcggtccaaacttagattggtatgtggtccgaaaagtttgtttaggcaagcgcgcctgcaatagcgcagtagttgcttcacactgtgcttggtacggatccccttttgttacgtacgactttggaatcccatggtatgacaaaataatttcgtcataggtttgcgtctgtagcttctgttcaatcgccgttgccatcaagtcgatatagcctgagcgttgataaaagtccttcacaaaatgcaaagttggcatgtttgattgttttaaataaaactgcgcaactacatcataaaccgacatcgtcgtagtcgttgaatattgcggatacattggcacgaccgtcaaatcatcgattcccgccgtttgaatctcactaagcacatcggttaagaatggttgactatatgacatcgcctcaaaaacttgataatcgggtaattcagcttgtaattgagcaacttgctgttgcatgtacacttttaatggggagccaaaccgctttgggcatcgcaacgacccgctgatcagctaagaaatgttttaaaaaatggcgaatttctttgacttctggtttatctggggtccccaaattaactaataacacaccttctttcatgataatgtcctccgcaattttaattaaaaccaaaaaaagagcggggaacaaaattggttttgtcccccgcttcaatgttaggccaatccgcattacttcgcgtattcgaccgttcttgtttcgcgaatcacagtcaccttaatgtggccaggatactcgagttggttctcaatttgattcttcacctcacgtgctaagacggttgcttggtcatctgtgacttgttctggtttaacaatcacccgaacttcacgacccgcttgaatcgcaaaactatgatcaacacctttaaaactattcgtaatactttcaagtttttcaagacggtgaatgtagttttcaagtgattcagaacgtgcacccggccgagccgctgaaatcgcgtcagcagctgcgactaagactgagataatcgatgttgcttcagtatcaccatggtgtgaaccaattgcgttaatcaccgttgccggttccttataacgcgttgctagttcaaccccaatttcaacgtgggagccatcgacttcatggtcgagggccttaccgatatcgtgtaacaagccagctcgtttagcgagtgtcacatcttcacccaattcagcggctaaaatccccgttaacttggccacttcaattgaatgattcaagacgttttgcccgtaacttgttctgaaatgtaatcgaccaagaatcttgattaaatcaggatgcattgtgtgcacaccaacatcaaagattgcttgttcaccgatttgtctgatttgttcgtccatttccttgcgtgacttatcaaccatttcttcaatccgagctggatgaatccggccatcttgaattaacttctctaatgtcatgcgcgcaatttcgcgacgaatcggatcaaacccactaagcacaactgcttctggcgtatcatcgataatcaggtcaatcccagtcagtgtttccaatgtccggatattccgaccttcacgaccaataatccggcccttcatatcatcatttggtaacgtcacaacagtcactgttgtttcagcaaccatatccgctgcactgcgttgaatagcttcagcgactaatgtgcgcgcagtccgatcagcttgttctttagctgtttcttcactttctttgattaaaacagcccgttcatgttcaaggtcttgtttcgtttcatccaaaatgattttttgtgcttcatcatgcgataattcggcaatttcttgcaacttcgctttttgttgctcaactaaagtggcagcttctgcctgcttttcagttagctcttgtgcttgattcgttaaacgattttcacgttgctccaatgaacgttcttttttatccaacgttgcatctttgcgatccattgtttcttcccgttgaatcaaacggttttcttgcttttgtacctcactgcgtcgatctttcaattcattttcaatctcagaacgatagcggtgattttcatcccttgcttccaaaagaatttctttcttccgcgttgcggcttctttttcagctgctgcgattattcctgtggcagtcttatttgcaccatcaatttcacgttcgtgcgccttcttttgtagaacggaaccaactagtaaaccaacgattaacatgatgactgcgaggattaatggaaaagctaagttcattgtttcacctccgcatcatcaaaaattttgaattgcaactttcactgcaaatttttaaagatgttattatgtttagtttttcaacacatagttattttatagtttcataaaccgcctgtcaacttaaactatcggcattgcaaccgttttcgagtttagtcaatcaaatcgaccatcagaataattcggttaagcaatcaaaaaaagctgaggcaaaataacttttgcctcagcttaatgattcttattcgtttgaatcgtcatccgtaaagacgtcgagttgtgtttcatcgctttcatctactgagacatccgaaataccatatgcttcccgaactttaagccggacttcatcttgaacttctggatgatcagccaagtaattcttcgcgttctcacgtccttgaccaatgcgttcatccccataggaataccatgacccactcttattaataatgtccttttcgaccgccatgtcgaccagttcacccgtttgtgagatcccttgaccatacataatgtcgacttcagccactttaaatggtggtgccaccttattcttaaccactttaatccgcgcacggttcccgatcatatcggtcccattcttgatagtttcagcacgccggacttcaagccgaacggttgaatagaatttcaatgcgcgaccaccaggtgtgacttcggggttcccgaacatcacaccgactttttcacggatttggttaatgaataacgcaatcgtctttgttttattgattgttcctgataatttccgtaaggcttgtgacatcaagcgggcttgtaacccaacatgcgcgtcacccatttcgccttcgatttcagcacgaggcactaaggctgcgactgaatcgacaactaaaatatcaacagccccacttgaaactaaggcatcggcgatttctaagccttgttccccagtatctggttgtgacaagagtaaatcgtcaatattaaccccgagggcagttgcatacttaggatccattgcattttcagcatcgatataagcagcagtcccaccttgcttttgcacttcggcaacagcatgtaaagcaacggttgttttacctgaactttcaggaccataaatttcaacgattcggccacgtggatacccacctacaccgagcgcttcatccaatgcaagggaaccagatgaaacagttgagacttgtgtatcaaccttttcacccattcgcatgattgagcccttaccaaaattcttttcaattttctttaatgcagcatctaaggctgcttgtctttcatctttagccaattaagtgccctcctcaaaagagtccttttcagtactctcttagtttaccgatttcacgaaataaaagcaagtaaaaatcgaacaaacgttctatatattttttttaagctactctactatacgcgaatcaccgcgtttttttcgtgctttttgggttaaaaaaactggcgtgggattccccgccagtttaagtttatttagaaaatgagtctttaaagacgcctctgttcttgatgaaataatcggtacccgaataaactgtaaagaacaagcaaacgtacaacatgatctgtgccattggaatgccgatgttgttaaagaagacgttgttgagtagcaatagaataatcgctaacatctgcgtcgtcgtcttaatcttacctggcatagctgcggccatcacttcgccaccttcgcttaataataaacgtaggccagtaacggctaattcacgccaaataataatcgcaaccacccatgctggcgcttgatctagcgccactaagaagataaatgctgtcatcactaataatttatcagccaatggatcagcaaacttaccgaagttggtcaccaaatgttgtgatcgggcgatcttgccgtctagtaagtccgtcaaagaggccacaatgaaaatcactgttgcaataatcgcactgactggaatacttgtcccagcgaccataatggctgtcgcaggcacatccaatactaaaatcaaagtaaaaatcggaatcaaaataatccgaaacatcgttaatttatttggtaaattcatgttgaagactccttaatgtcctttatttagccaatgttgctgtgaaataaatcgtccgcacaaacgttgcttcgttatttggactaaggttaatatcggtgccattaatcttcatcttcgttgcaggtgcattcccagtttgaatactaaattgcgtaacgccttcaggtaattcagcagtttgttcggcaccaactgcgacagaaccttgccaaatttgttggccgttggccgttaagctgacccaagcagctgatttatcagctgagaacgtaatttggttggctttagctggcaagttcttaatttcaaaagcttgttgcgacccattaatgctggtcatcttcgccgttaattcttgcttcttagccttatcttcagcagctttcttgctagcttcttgtgccttactttcagaagcggctttcttactgctttcagcagacttgtcttccctactgctatccttcttaggatctggtttatccccagaaaccgtaaccgatgagcttgtttcgtttaacgtttcgcggtctttaccacggttgctgagcgcaatcccatagaccaccccaataatgatgaccacaattgccacaatcgtaatttgtgggacaaggttgcgccatttcgaccatttagaatctgttgtttcgcgcgtcaatcgggtttgattttcaacggatttttcaacatattcttctggtttcgtatctggtacagcatcttggtattctgccaacaatgcatcattatctaagcccactgtttgggcgtattgcttgataaatgcccgcacgtaaaaactgccaggcaaggcatcaaaattgccctcttcaatggcgattaaatatcgtttttggatttttgtgatttgttgtaaatcatcgagtgtgtagcccttttcaattcgtgcttcacgtaatttttgaccaatttcattcataatcaattccacccactattatcccagtatcattatccataattatagcatattggtacgtatgtgcattattaagatttctttattttaaccaaccaccattaacgtacaatgtctgtcccgtcatataatcggctgcaggtgccattaaactcaatacccaataggcaatctgtgctggggttgcaaaagcaccggccgggatctccgctgcaacagcagcccgttctgctgttgtgaactgattgttcattttcgtattcactgcgcctggcgcaaccacattaattgtgattccaagcgatgccacttcctgtgcataggcgttcacaaaggcggattgtgcgcctttaactgtactatatggcacttccattgcactgccccggccaccatagattgaaccaattaaaacgacgcgtcctaatggactttgcgctagtttcgcttgcagctgctgcatcaatagcattggtgctttaacgtgcacctgccataagtgatcgagtacggttgcactgacttctgacaataagccatacgtcgtcgcgcctgctgtataaatgaccgcatcgacttgaaaaagctggcctgtcaattttgcaacagcgtcctcttgggttaaatcagcttgaagcgcaaaaaaatcctgttttgggtagtcttgcaacaattgcttttgcagcgtcgtaacccgcgtctgattttgatgataatgtaaataaagtgaccaaccgtccgccgccatttcagtcgcaaccgtcatcccaatatcaccggatgcaccgataattaaggctgatttaggcatggtttgcttcctccggtaagatgtggcagactgtcatcgtttcaattttgaaataatcggttgccatctgttgcaagtccgctaaagtcacttgttcgatcaaacctaagacatcaaatggactgatttcggtaaagaattcatcactatattggttcgcaatggcttctagcgaattgaacgcttgcaagtattcaccaattgcggctcttttaaccaacgccaagttatcctctgaaaagtcaggactttccgtggcatgttctaagatattaataatcgcatccgataattcttgggcattgtccgcatcgccaccaagggtcacgaaattaaatgaccgttgaatggcaaattcgtaaccaaaactatcatcaagtgtgccatcatcgtacaacttttgcacttgcgttgatgaatcaccaaatagcaattcaagtaacaagttcatcttcaactttgtttcaagtgctaactcacctgttccgtaatccgttaaacctttaatcccaaccatgctcttgctgcgcgtaattggcatttcaagtgaccgatacggaatgatatcatgaccatcttcagcttcttcaggcaatgaacgtacaatttctgttggttgggcaaatgtttttgccacttgattggcgttcaaccaatcaaccacttcatccggatcatcaatttgcccaacgataaagaggttcatattactaggctgatagaacgttgcatgtgcttgatagagcgcttctggtgtaatttgcgcaatactatccaccgtcccagcaatgtctgtccgcactggatgactcggatagagattgccaatcactgtatagaataagcgccaatccggttcatcattatacatctggatttcttggccaatgatgcccttttctttttcgaccgtctcagttgaaaaataaggttcctgcacaaaatcaagtagaatatccaaattttctcgcaagtgactggttgttgaaaataaataactcgttcgcgtaaaactcgtaaacgcatttgagcttgccccgtagcgaccaaacttttcaaacgcatcgtaatcttttttctcaaataatttatgttccagaaaatgcgcaatcccgtctggcactgtcacataatccgtttccccagctgggataaacgtcttatcgattgaaccataattcgtcgttaagattgcatatgtcttatgataaccgctcttagggtatattttaacggtcaagccattctctaattcagtttcatagagggtttcacctaagcggggattttgtctaagcttcatctgtatcgacccctttcaggaagtaaatggcttgcaattgcatctttgcggcttgttcttgaaccgcttgtttagaaaccgccaagatggcttgtgtaaatcgttctgcatcaatttcagtttcaggcacaaacaaacgattaaattgttgttgccccaaataggccgcactatcgagactcgatttaaattgattaatcaaggccaacttcgtttgttcaaagaccgcctgttcaaagtcacccgcgataatccgttgacgttgggcttcgacaatctctaagacgcgatctttttggcgactttcaatcccagtctgtaccgtaatgacaccccgaaaagcatcgattgcacttgaggcatagtaggctagactcgctttttcacgcacattggtaaaaagtaacgacagcggtgtgccaccgaataaggcgttcatcaccattgtggcataataatcagcttgatagaagtaagctggcatttgataggccatgtttaacttgccttgttgcaccgtttgtacttctgttttagtttgcacttgtggatataacgattgttgataaaaaatcgttggcagttcaacattacgcggtgcaaatggcaattgtgccaaatccgcgaccgttttggcttcgtcgatattaccgacaaacgtcatttggacgcgatcgtttgcaatcatcgactgataatacgcatatagttcatccggtgtgatggttgctaaatcagctgcatccccataattgggaatttgttgcgtcgcatctttaaaatagagtttgcgtaattcaaccgccgcgtatgattgcttatcatcggcaacactttcgatataccgcactaagttctctttttcacggttaaaaatgaccggattgaactggtcctcaaccacatctggatgcaataataattgcccgataaacgcaatcgcttgctcttgtaagtcgattgtatcccgtagatattgggggctcacaattcgcattgagatgctaaaaatcgccaagttcccttgtcgataggcattcatattaaaaccggcaccatacatagcttgtaattcattcgcaattgcgacttggttacgataggcttggctactagcacctagaacgctcgctaataatgagcgccgggtcatcccatcagctgtgacgggggcaattaattgaacggttaatctaattgttttaaattggttagtttgtaaaatattcaggtagacgccatccgttattttctgattcacgttatattactcctcactgtttcaacagttaaaatggctcttttcaacttatcctttttcatagtacggattctatcataccaaaaaaagaaggtgaactcaaaaaaggccgcgacaatgttaggcgtaaaacgcgttgcatcgaaagatctttgaaaaaggccgcatttttaaagcgcgtactaatcatcagaccagggaaatacaacgaaccgcccactagccataaccagtagttggcatacatcccaccaataccaaagccaaagatcaaaacgacactaatcagacaccagattgacaggccggctaataagaacagcgcaatttttgaaatcgcaattaagatttctttttgtgacgcttttttaccatagaaattggcccgtaaactcgcacctaagaagcccccgaatccggcaatgttcgtaaacgtattgacgatccaaccagatttgactttataccagaatgaatagtcctccggcagcaactccgcaatcacgaaatcataattgagcattggcaagactgccacaaacccaatcaccagcatcgctagcaaggtccacggactttgcgtcgttaaactcgcttttaattgttccccgttcaagtcccggaaaatccggccgacttctaggataacaaagaccatcaccgaaaggatgaagatgccttttaacaacgttaggtgtcgctgaattccttcatatatgtgtttgccccattttcgcatatcaaccgctccttaacttaattaatttaattataagctatcccaaggcaaaacacagtaaaatgacaattatgttagatggctgttagattatgattttcgcttattacttacccggagcacaatccgattcgcgctcacccgacaatcaatattctctgattgtctttttagtcctcaacagcaatggctgtcgcttaagatatggaatccatatttagcatcgtgttattttgtgcaactcgccatttatactttacaaaaaaatatgtaaaaaaaaagaaccccacattagtggggttcttttagaaataaaacgtgctttcattaactgctttctgcgctttgctacatcagtcaaatcaccggctacgccggtaatccgcctgattaggcatatgctcaaaagcaacccgttaatgacgcactcttaaattatttcaagttaacgacagcgccaacttcttctaatttagctttcatttcttctgcttcgtctttagcaacgtcttctttaagagctgaaggagcgttatcaactaagcccttagcatctttcaagcctaagcctgtgatttcacgaacggctttgataactttaaccttttcttggccgatttctgataattcaacagtaaagctgtctttttcaactgctgcgtctgcaccagctgcacctgctgctgctactggagctgctgcagaaacaccgaattcttcttcgattgctttaactaagtcgtttaattctaagattgatgattcttttaattgatcaacaattgcatttacgtctaatgccatttttgtttcctccattttgtgggtaatatttttttgataaatcagtttaactacacaattttaaattatgcagctggttcgtctttgctgtcggcaactgctttaacagcatatgcgacattgcggactggtgcttgtaatacagaaagtaacattgataataaaccgtcgcgacttggtaatgtagccaaggcattgatttcatcaagtgttgccactttaccttcgatcataccacctttgatttcaagtgcatcagcactcttagcaaagttagcgatgatcttagctggtgcaacaacatcttcgttagaaaatgcaactgctgttgggcctgtgaatgtatcatccaaaccttcgtaaccagctttgtctgctgcacgacgcaagtaagtgtttttaacaacttccatttgtacgccagcttcacgtaattgtttacgtaattcagttacttgttctactgttaagccacggtaatccataacgacgatagaaacagcactattgaatttttcaacaactgtgtcaacaatttgtgctttttttgcaatgattgtttcgctcaattgattcacctccattagatttgtaaaacttgtggtcaagagttccttataaaaataaaaaactccatgtccaccaagacatagagagggatttcaacgtatcttcctcggcaggatattaagcctattggcacctgagtcttcggtagcataaataaccaactacaaatatagcatggattccataaagcgtcaatcattatcggcacttaattttagttatcctagcattacgttttacttattttatttttctgaaaagacggtttaaaattgagactatcaagaaaattaatcgtaagaggtgcagttttttgaataatattttagtcgttaacgcgggtagttcatcattgaaatggcaactattccaacaatctgatttaaccttactggcaagcgggctcatggaacgcatgaacacaccagaagctagcttcaccttcaagttccaaggtcaaaaagaacaaatcgccattgctaatctttcatatgaagatggtgttcttcgacttttgaaactacttgaagacaatggcatcattcattcacccgcagacatcattgcggtcggccaccgggtcgttgccggtgctaccacgttcgaaaaaccaaccattattgatcgcaccaacttagatacattaaaacaactcgacaagtatgcacctttacacaatcccgtgcaagttgactgcattgaaaccttgatgcatattttaccaactaatgtccctcaagtggctgtctttgatagtcaattctatctcgatatgccagatgaaactagtttttatggcttaccttatgaatacagccaagactatcaaatccgcaagtatggcgaacacggcattagtcacagctatatcttacaagcaacagctgactttttgaaagaacccgttgccgatttaaaattaattacacttcatttgggtggcggttcttcaattacggccagccaaaatggtaagcctgtcgatacatcaatgggcttcacaccgttagaaggcgttccaatgggcactcgtgctggttcattagatgcggccatcgtcccattcttaatgaacgaattggataagagtgccgatgacgtcatcacgcttttgaacgccaaatcagggattctcggcgtttcaggcgtttccgctgacatgcgcgatattcaatcaacacgcgctaccaatccacgggctaaactcgcctacgacatgtttatcacttctgctgtgaagttcatcgcgagctaccacgttgaactcggtggtgcgaacgtcatcactttcacagccggcatcggtgaaaacgacgcccgtttacgtgctgatatctgtgccaagctggctgttttaggcgttcaaatcgatcctgaattgaacgaaaacggctcaggtgcccgtcaaatcagtacccccgattcagccatcaaagtcttgatgatcccaaccaacgaagaattgtcgattgctaatcacgtcctagcaaccatctaaattaatcgcgaattatgagagagtcattagcgtttttcatgctaatggctcttttttgataaaataaacccttttcatcaccaaatcacgaacgatatttacagaataataaacatttttcatattcttcttaaaaacacgattgttttattgtacaacaatgccaaggttcttaaaatactaatccagaggtgcataatggataagaatattgatattgcaacagaaacacgaacgaactggttcgaacgtcaattcaaaattaaggcaagtgggtcgaccattaaaaccgaaatcatcgccggaattaccacttttattgcgatgtcatacattttattcgtcaacccaactatattaggcgacgccggcctagataagggggccgtctttgtcgccaccgcattaactggagtggtcggctgtttagccacggccttcatcgctaactacccaatcgccgttgcacccggactcggcagcaatgctttcttcgcctatcccgtcgttttaggcatgggcattccttggcaaacagcacttgccggtgttttcgtcgcttccctccttttcatgcttgtcacggtcttaaaagtccgcgaagtcgtgattaacgcgattcccactaatttaaaagccgccatggccgttgggattgggttattcatcgcctttaccgggttaaaacaagggggcatcgtcgtcggtagtgctaaatcatttgtcaccattacgagttggtcagatccgcacgtttggttgaccgtcttcggtttaatcgtcaccgttgctttattagcccgcaaagtccctggcgccttattcatcggtttggcggccacagccatcatgggagtcgtgactggtctaatcgcaatgcctcacagcatcatcgcttcaattccaagcttagcacccactttcggtgtctcaattatgaacatccacaacgtcttcaatgttcaaatggccgtcgtaattctcgtctttttcttcagcgtcttcttcgatacaactggaacggtaatcggacttgctcaacaagctggtttcatcaaggacaacaagatgcctaaggaagtcggcaaagcccttttcaccgattcaacctcaatgattgccggttccgttttcggttcaaccccaactgcttgttacatcgaatcatcaactgggattgctgctggtggtcggcctggtttcaccgccgtggtcgtcgccatcatgttcgtcttaagcttattcttctcacctttactggccgttgtgacgtcgcaagtgactgccccaatcttaatcatcgtgggctcattcatgatgaagtcaattgccaacatcgactggtcagaattcgaaacttcttttgcagccttcatgattattctgtgcgtcccattaacctataatatctcatacggtttagcattcgggctgatcacttaccccatcaccatgattgctgctgacaaaggtaaaaaagtgcatccgattatgtatgtcgctgcgctcttattcctattattactcttcacaatgcacgaattacctgctaaataaaggagattactcatggataaaacaactttaaaacaactaattgatcaagctgccggccgtcaagctgccgacatggtcattaaaaatgcaaaggtcgtcgatgtctataatggccgcattattgaaggcacactcgcgattggtaatggtcgcttcctcggtatcagcgacgactaccttgcaccaaaagttatcgatgcacgcggccaatatgttgtgccaggtttgattgatccgcatattcatatcgaatctgccaatgtctcacccgctgtcttcggatcacttgtaacaccacatggcacaacaacgatcttggccgacccacacgaaatcgtgaacgtcgctggcatgcgggggcttgaatacatggtcgcatctgccaaaaagacagcacttgatatcaagtacaccatgccctcgtgtgtggtgcctactgctaatccaaccctcgaaacatctggtgctgtgattaccgctgctgaaatccaagattcttacgaccgcaatctcacttacggccttgccgaattcatgaattatcccggtgttgtcaatgctgatgatggcgttttagacgaattactcgtttcactcaacgcaaataaactcatcgacggtcactcacccgctttaaaagaacaaggcttaaacgcatatgccgctgctggtattcgtaacgatcacgaatgtacccaagtcgatgaaatgctcgatcgcatcagtcgcggtatgtatgtttatctccgctacggcaccgtctctaagaatatgtcaacccttttgaaaggcgtgacgccgcaaaacgcacgtttctgttgtctctgcggtgacgacttacaatccgtaaccctccgtgaaactggccacttggatgaaagtatccgcgttgctatcgcaaacgggatcgaccccatcatggcaatccaaatggccaccatcaacactgcccaatgtaccggcttagctgaccgcggcgggattgcacctggtttgaaggccgatttcctattggttgatgatctcgaacaattcagtgtgaatcaaacctttatcaatggtcaaaaagttgctgccagcggcgaatacctactaacaactgaagattcagttactggttttgatgacttgttacaaaccgtacacctcgatacattcaccgctcaccaattaaaactcaaccttacaagcgataaagcccacgtgatcggcttacaaagcatcagtcggacgcaaaatctcgtcttaccggtcgctcacactgcagacggtgatttccaatatcatcctgacgaagacatcgctaaagtggccgtagttgaacgacatcatctcactggcaatgtcggggttggcctgcttaacggctttggcatcaagaacggtgcgattgccaccagcatcggccacgatagtcacaacctcgtagtagtcggcaccaacgacactgacatggtcgttgccatcgaagcgctcaaagaaagccaaggcggtggcgttgctgttcaggatggccaagtcatcgcgacattaccatttgtcatcggcggcttaatgagtaacgaacccatcgacactttaattgaacatcaaaaggccttcaatgctatttgccacgataaactccacgtcaccgctcacttcgatccgattatgaagctcggcgcaatgccactcgacgtcatcccgaacttgcggattacagataaaggtttagtggatgtcacaaaattcgaaattatcgacattaatgcttagtttgaacgaatttaaaaaggaacccccaaaacggaaggttcctttttaaatttgttcaaactattgatctaaacgcttcctaattaaagagtccgtatatttcaagaattaataaaataattaacccatccaataagttaacttatctctttaacgccgatctataataaattaaccgcattaaacatcatgcactatcacgtgggcaccaactattaacagtaaccagtcgaattgctatgattgtttgtgtaatattaaactcattcaaagttgattcatctaacgtctcaagattcgccaattatagttacctacataaactacaatttaatcaacaattatacttgattaaatatggaagttacaaacagtgagaactcttttaagaatctaaccaagtttacaatatgaaataaatattctttaacatagtctgctgtatatcggatttaataatccgctttaccagtaactgttatcttattggcgattaatactggtgtagtatttttcccaccaatattagtttcatatgtctcccgtttactaaagataccttgtacatccacaaaatcatctttaacagcatcagttgtttctttcgaaagcaccatatataagttgctagggtcgtcatctgtgtacactaataacatagtgccattttcttcctcatttgcttgtagaacctgagcttttgaaatatggaacgattgtccaacccatttatcagatttaataaaatcaccataaccatagttctgtgcattactttcaccctcggcactatcataaactgaagattccgattcactagagctagcttcggtagaatcagaactcgattcattgtcatcactggaatcattaccaacgttatttaaataattaacttgtgcctgattatacgttaatttcacttcaggtaatttattttgaagatcactcactaccttcttgggtaatgaacttttcacatgtgatgttttgtaattcgatatagcacctataaatactttaacagtctcaccaactgtatagtcatcaccttttcgcatgaatataccactaataaaaactttaaacttaccttggtggacttcagagaagcccattgaatcatctgtagttcctaaattttcaccgaaatacatattttcactatcaaccggcataacaataatttttgtattattaggagctgtagttttccccgatacaatccaatccccgtagtcttgtgaaattttctctatcttagtcttgtaaacctttttttgttccacatttttagtagtttccccattactacaagccgctagaacaaccgaaaaaattaggactgaaaagatactaattatttttttcatatataattcccccattaatattactgcactaaattatcattttactttaaatattatatcacataatccagggaagtgtttatagtaaatatccacccgcatagcgggtggctttttattagccctagaagggctcaccacacgagaaaaagcccctttaaggggcccaacaaaagaccaccaaccgctcaatcgttcaactgatgctaatttacttcttaaatgggtcagtgtattcttttttactaatactatctcttactcgatcttccacttcttgttcacgtatatatttttcaattattttctgatttaatcctaccgtactaacataataaccttttgcccaaaagtttcgattaccatagttatacttcaaatttgtatgccgctcatgaataataactgcacttcgtccttttaaataccctataaagcttgaaacgctcatttttgatggtattttaaccaatatgtgtatatgatctggcattgcatgcgcctctaatatttctacatctttcaactcacataaccgacgtaaaatcttaccaacgtcttgtcttaattcaccatatattattttccgccggtacttcgaggtaaacactatgtgatattacaattccatctggtatgtgctaaactactatcgtcttttacttgagacatgataaaaatccctttcgcttttagatttggtcggtagccattctctagtatagcgaaagggatttttaacgctgaatctaattctaactcccacacctaaaaggtgtggtttattttcacctaaaagaataaaaaaagcgatcaacaaccggttattaaccgattgttgatcgcaagccattgatagcttagaagctagcaatatcaactttgacaccagggccaaatgttgagctaactgataaacttgtaatgtattgacctttagctgaagcaggacgagctttgataatcacgtcttgcatcgctttaaagttttctactaatttagcagcatcgaatgataccttaccgattggtgcgtgaacgataccagctttatcaacacggtatgccacttgaccagctttaatgtcgttaactgctttagtaacatccattgtaactgtaccagtcttagggttaggcattaagcctttaggtcccaagacacggcctaaacgacctacttgagccatcattggtggtgtagcaacggcaacgtcaaagtctaaccagccgccttggatcttttcaactaaatcttctgcgccgacaacgtcagcaccagcagcttcagcttgttttgcttgttcgccttgagcgaaaacaatcacgcgttgtgtcttacctgtaccatttggtagtacgacagcaccacgaatttgttgatctgcttgtttaggatcaacgtttaaacgatatgcaacttcaagagatgcatcgaattttgcaaaatcaactttctttactaagtcgattgcttcttcaacagtgtatgctttagtagcatcaacttgttttgcagcttctaaataatttttaccttttttagccattagggttttcctccttgcaattgtggtgaacggtttttgacctcccacttgatttttcaactttcattgaaaatccgactgaaagtgtcaagcatgaattaaccttcgacagtgaatcccatgcttcttgcagtaccttcaaccatgcgcatagcagcttcaacgtctgcagcgtttaggtcttgcattttagtttcagcgatttcttgcacttgagctttagttacagttgcaaccttcttagtgtttggttcgccagaacctttttgaacaccggcagctttcttcaagagaactgctgctggtggtgtctttgttacaaagtcgaatgaacgatcttcataaacagtgatcacaactggaattaataaaccagcttggtcagctgtacgagcgttaaagtcctttgtaaagcccataatgttgataccagcttgacctaaagctggacctactggtggtgctggagttgctttacctgcaggaatttgaagtttaacgatgtttgctacttttttagccacgaaacatacctccttaagtccgtgatgtggttaagatggccattatatttggtctcccactagtgtatgaaaacataccttaataatataccaagcaattgccgaaaaagcaaggcgattccattaatcgcgccacaagaaatcatcaatggcttgatcaactaagcgattttcgtgcaacatgctatgtgctccacccggtccacgaactaacatctcctggtaatgacgcacgtgtccttttaataggctgcgcaatgcaaaactactatcgactgctaccgaaccatcgtgtcgattagttcctagtaactcaccagcaatgtttaagacactgatcgtagttggaaaatacttggcccgcacggctaaataattataattacgtgttcgtttaactggcccacgactggttaactcgctccaaaaaacaagtggtgtatccggaccaatcgatggatcattaactggcgctgccaacaatatcactttgtccaccacggcatggtctgatgtcaacaaataacgcaacaccgtaattgcgcccatcgaatgccctactaaattaacttgcgtaacgccatacgcttcttttaagtgttcaataatcgcggctaaccaacggacttgatcttgcacatcggcgcggttattagcaaataagacttgaatcgttgggttattagcctgcaacgccgcgtctccatccacatgcaatcgaccgtttctgcccacccaaatgaccatgctcttcttagcaattccggctttttgtaggcgtccgagtaagtgaccgaatgaatagcgattcccccgatagccatgaatgaatagcgttggttgttttgtatataaacgtgcgcgcggccgccaatgtgccgaaacccggattaatttgtaaaaatccagtcctgccagtaagactaacaaaaaaacgactaagcccactgcaattaatatttgatcaatgatataccacatcgtcatcacatcattctttcgaaatagacactattgattgttcaaaaaaagcagctgagacaaatcatctttcgtctcagccacctatcttgttggggcttgggacaaatcctagccccctactttaattgttgaaacgtgctttttgaaactgactcttgcgcttaactacatttgtcaaatcggcgcttgcagcatcaattcgccaaattaggttaatgctcagagtcaatccgtttcaaacgcactcttttttcgaaacgttctccttcagtcatcccgactgaagtcgcactctaaactagttcgtctacttggtcgtagtctaattctgttgctgtttcacgaccgaacatgtcgatgttaacctttaatttcatcttttcgtcgtcaacttctgtaatttgaccgacaaggccagcaaaggccccttcgataatcttcacagattcaccgactttgaactcaacatccaaatgacgagtgctcatgccaagttgacgtaaaatttgtgtgatttcatcatctaataatggggctggtttgctgcctgcaccgtgtgaaccaacgaagcctgtcacacctggtgtattccgcacaacgaaccaagcttcgtctgacatcaccatttcaaccaaaacatagcctgggaaagtcttcttcatgtcgactttgtccttaccgtttttgatttcatgttcttcttcttcaggcaccacaacgcggaaaacattgttctccatccccattgattgggcacgcgattccaagtttgccttcactttattttcgtaacctgaatatgtgtgtaagacataccagcttttttcgattgattcaaccatgtgcgttctccttttaaataccaaaataaaaaaactccgaccacgcgaagttttttgcttgccattagtatagcaaatccgacttaattaagccagttctaaaagataaataattgtagtacttttaagattgcaaaatcaacaacgccaaagaaaatggcgaataaaacggaggtcatgacgactgttgatgtatctttacgtgtttgtttggcatctggccaactaacagttttcatttcctgaccgacactcttaaaaaacttaatcatcttatttcctcctaattagcgcgtttctttgtgttgtgagtattgcccacaatgtttacagaatttgtttaactctagacgttctgtccgattcttgttctcagcaacatagtagttacgtgagccacagacagtacaggctaaggcgactttcttaacacccatatgaaaagcccctctctaattgacgtttatcccatttactttatcatgtgttgaccaaactgtcaatgtggtggattatcgccaccaggtcgtgcggacaatcgctaataacaagctgacaatcaagctaatattgatcgccatcgcattttgaatcgcggtaataaaggtaacatccttcagttgccgcgtattaaaccggcgattattgcgcaaaatgacaggaatcaataataacaatagtaacgattcaattggtaagaccttcgtaatcactgccacaacaacggccactagtgagaaccaaatcaacgtattatacaaccgcaacgcccaggttgttcctaaataatgcggcagtgtataacgttcattgcgccgatcttgatctagatcacagacattatccgccaacataatgttcgaagtggggattgcaataatcacaccgattaggcatagactaagcaatgttggtaattgacctttaagggtaaacgttggccaatcaaaatggagcgccatgatgctgtcgcttggcacgttgacatagaccatgataaaaaatgcaccaaatgattctgtcacaccactcaacaattcaccaaccggcatccgcgatagcggaactggcccgaacgtgtaaaagacggccacaaaaatacaggcgccaccgattaatagtaataaaatattcgtttgccaaaccaaccaaattccagctgccatgctgaacaataaaaaatagagcattaaatgcagtgccttggttggcgacaaatgtttgcgcccaatgatattcgtctgtgcccgataatccagatcaactgctttgtagtaatccatcacattattaaagcctgtcacaaataatgcaatcgaaaactgggcgacaaaataaacaactgtcgtcactggattcagctggccattaacgtaccaacaataaacaatccctaagattaagggcaagacactcgctgtcttgacctcaatccggacaaattctaaaaacgttttaaaagacatctcggacttccttccattaaaaaagctaggacaaattgacttgtcctagcttcatcgtaccttctagcagacagttacccattaattcattggcagctgactgccgaagtcccgttttattcaccgtaaacgatgttatcaactgtaatcgttgctgtatttcctttttgtgcagcattgactaattgttcagcatagttgacgaagctgtgtgatgattctgttgcaccagaaacaacatctactttgcctggttcttgtgctttgacgaattcagaattcaacttagcgatgtattccttaggatcagtcttagcaatcttcttcatttgtttgttgtatgcagcatcgtcagcttttgacttgccatctttattgatgttatcgaatttagattcagtgattttaccgtctttaaccaccattgtgaaaactgttcgatagtcatggctgtaattcttttcttctaacttatatgtgccatcttgcatcttagcaccattgtcgatttcgattgtttcagtgttgccagcttgagcagcttgcactaattgttgtgcgtaattcttaaatgaatttgagctatgagttgcgcctgatacgacttcgatgcttgaaacatctgcacctttatctgtaaattctttgttcaacttaggaatatattctttaggatttgtttttgaaactttcttcattttttcgttgtatgtcttgtcatcttgttttgacttgccatctttatcaacgtaatcgtaagttgtctttgtcactttgccaccggcaacggtcattgacatcttaacgcgataattattttcgtagttcttttcttctaagttgtaagtgccgtcttttaattcaccgccggcaacttgtttcttagcggttgcttttttgcttgatgattctttgactgaactagattttgcctcttttgaagatgaatctttaatgaatgagttcttcagaacgaagaacgatcgcaacttgatgcgcggtcatatttcacggtatggtaatgttttatggacagtccctgcgcgaattttcttaggcgcaatgtggctcgttgattgttgggacaaggttcaaggtgaaggttcttggttcaccaataagctccggttaccttttgactggcttcaaccagctgtcaccagcggtgcttctaaagcggcggatgcaacaagtgctgccagcggtgccgctgcaggcggggctgctgaaccagcaaccgctaaagtcacattcggcctttcttacttattcggtcatgatccaatgcccgtcttcgataagatgccccactggttctacagcatcacgaaggtcttgattccaaaccaagaagttgccttcttcatgcaaaaaacaatgaccatcattgaaattttaattggcttagctttaattgctggtctcttcacttggttaacgagcgcagcaaccgttgcaatggttatcacattctgcctttcagggatgttctattgggttaacatttggattattccaatggccctcgcctgcatgaacggttcaggccgtgccttcggattagataaatgggttgttccatatttacaaaaacatctcggtcactggcgctacggccaacaacgtgcactatacaaaaatcaatgagtgcgtttgaaacggtttgactttaagcattagcacagggaagcgaattagcgacatagtcgatgatttaattcacagcgctaaacgcagaaagttaacttcaaagcacattataaaagcaattcacagctatcaaaaggagggggttatgacagacaggctttcgtcataaccccttttattgctattttagagagaaagactgacgcctatgtttaaacaaattcgcgctaaccgttacatcaaaatgattcgccctggtgatataatagtagtcatcggcctgtttattctatcgtttgccccagttgctgtttttagttggcacgaatggcaaacgacgcaagcagcggattcaaacgcgcaggtattgacggcctacgtcaaacacgatggcaaaaccgtctacaaagtgaacctaaccacccaccatggtgttagccacttcacttatcgcgatgccggcggtgattacaacaaaattaaggtaaccgatcatgccattgaggtcactgaagccaattgcttcaatcagattgatgttaagcgtggcaaaatttctaagccaggccaaaccattgtttgcttaccacacaagttactgattgaaattaaagccaaggatgggaccgaacacgggcgggatggtttctgcctgatttaaaaggagtacagcgatgactaacgatcaaacgcgtcaatacatctatattgcactcttgtgcgctcaagggattattattggccttgtcgaacgcgcgattccatttccatttgccgtagccccgggtgctaagttgggactagccaatttaattaccatcatttcattatttaccctaccggtcagcgactgctttttattgatggtgatgcgaactgttttatccgccttgctagggggaaccctctctacttttatgtatagcattgctggggcaacgctaagtttctttggcatggtactcctcaagcaatttagccgccgctttatgagtatgattggcatctcagctgctggtggtctgctctttaatgtcggtcaactctgcgtcgcgagtttcattgcccagagttggcaagtcctcctctatctaccagtgcttgcttttctcggtattctcgccggaattgcggtcggcgtagccgcgaattttttattcgaacatgtcaaaaccctgacttttttaaaagcccaacacgaaatttaatttaacaaggagttaattatggcgaaagtacatgccatgtggcagaactatccagaaatcgaaaccgaacttgcgcaaagtcttgcgctcattgaagacaacattcacaccaaaaatcaagccgtcaccgacgccattttaaagatgattagtgctggcggcaagttgctccgccctgcttactgcttattattttcacagtttaatgcagtcgatcgacagaagatgatcgcattagccgccgctgttgaaacgctacacactgcgacattaattcatgacgacatcgttgataattccaatttacgtcgccatcaagaatcgattcaagcccgtttcggcaaagatgtcgccgtttacgctggcgattacttattcgttgtctgcttcaagttactagccaattatgcgagcgatttgaagagcatccaatttaacagccaaacgatggatcaaattcttgacggtgaactcagtcagatgacaacccgatataatctcgatttaacccccgaacagtacctacaacaaattaacggtaaaaccggccaactgttcgcgctcagttgcttcatcggtgcttacgaaagccaaaaaggcttgaagtttgcccgccaatccgagaaaatcggcttaaatatcggtctcgccttccaaattctggacgatatcttagattacactcagaccgatgtcgattttggcaaaccagttctcgatgacatgcgacgcggcgtctactcgattccgttaatcatggcactgcaatccaatcgccaaacattagcaccctacttggaaaaacaagcagctatgactgatgccgatgtgcacgctgttcaaggcatcgtccgtcaatctggaagtgtcgaaaaagcccaagcactcgcacaagattacacaaaccgtgcactcgctggtcttgcgaaactacccgacatgcccgcaaaaacaacgctacaacaattaactgaacgtttattaaccagaaaagcctaaaaaagacggacaacatgttagaaatgttgtccgccttttattctcgacttaatgctcaaagcctacccagttcgagtcacactcaattttttaagctgtttatcggatttgaaccgacgacccccaccttaccatggtgatgctctacctactgagctaaaacagcatttcacggttgattaacaaccgtgatataagtatatcgaaaaataaaaagcgggtcaagcccctagagaccaacttctgtatcagaaagtgctaattcaaaatgttgttgtaagaatttagcgaccccgtcattcgtattcgtttctgttacataatttgcagccgctttgacctctggtaaggcattgtccatcgcaacactgtacttcgctgattgcaacattcccaaatcattttgcccatccccaaagacaattgtatgatcggcatcaattccatgaatcatttgaatctggcgaattgcagtggctttatcaatcccggttggaatcatctcgatgttgtctggaccagaagaagacaagctcatcacagcttgatccattaatcgttgtttagcggctgctaaactctctggatgaccgcgaccaatgataatcccgttggtaatctgatcacttaaattcaacaacatttctaaatcagtcaccggttgattatcaatatcggcattcaacaataaattccccgcatcgcgcgcaacaaacttggggatttcttgggtatagtaagctgtgtcagtggtaaaaaagtgcgcagataaattgggatctgctaagcatgcttcgtaagcagctttgagcgcttttttacctaaataatgcttgttcatctgatggccattttcaaagacagcaccgttagaagccacaatccggacatcatcgttaatttgccgcgaaattacccggccaagattgtacattcggccggtggcaatatagaaaatcacatcgcgtttttgtaatgttcgaatcacgcgtttggtcaaaggtgtcacgatttgatggtcaaggaccaacgttccatcaatatctgaaaaaactaagtaaggttccatatgaattcccctcaattttgatttgtaaccggtaacactccttcgttttagcgtatttagatggggaattaaatagccaatttcgtttcattcacaatcaaacgattaatttataacagtaagtcttgctatttaccatgacatagtttattatcaccttatttggtaattttaataatgtctgaaggagtttttggctatggataaagaagatctcaatatcggtgatttagtaaccggcaaagtgaacgaagacctagatggtgcatttacaggaactgttgaaaaagtatatgaaaactccgctttaattagcattacggatttcgatgcagccgacaaggccaacgtttcggaattaaacaacaagatcgttgttaacctcaagcaattaaaagctgctaaagcaaaataaaatagaaaaaagcccaccggcatttatttaccggagttctcattcaatgaaaaaaataattagcattattgcggtaatcgccctcatcatcgtcggatttgctggctaccgttaatacaaaaatacgtatgtcggcgaagtaggctacgccaaagttgctgctcaatctccagctcaaagatgattcaggtaaaacagtgactaatatgtatagctatcactaccaactaaatgtggtgaaagaagatgatagccaccaagtggtccctgtcgaagttactggcgaaaatccaacgccactcactcccaacagctatgtcaaagttgaatttaattcaaaacgcgtcttaaaagggcctaatactgtgtccaagaatcaaattccggctaaagttctggcgggtttagataaataataaattagcttatcctagtaccattaatacttgttattagctgttaccctcttaaattaagttattaaaaagcagtacccttgattagttatcatgggtgctgctttttgtatgtttcctgtgaaacattttgttttgtttgattttctttaaggcttcacgttgggcgaagattgttagttcgtgttcttcaacaaacgtcatcacccactcagggttttccttactatagttacgtaaagcccagccaattgctttttggataaagaactcatctgtgtcaatatctgccagaatggcttcttccaaaaacgccacattcgttttttcgtaaaaactgagttgtagcgtaatcgcaatccggcgcagccagaaattctcagcacctataaaatgctgtgcaacccaatcaaactgttcaggatgcagtctgatgtactctccaaatacttttcgccaagcatcgatgctgtcccaccaaactttttccaacaccaacgttaataaatgttccatatcagccggttcccaccaacgtactgaacgcaatgccatctcgatggcaacatattgatactcacgcgttggtcgagcatataaggtctcaatgaactgcatcatttctgctggtggcaattgtttcacagactgccacaattcgcgttcaattaaatggcggtccggtgctttaacaccgttaaattcaaattgactctgcatgtatttcttcattgccgcctgattttctggatatatcggtaattcaaaatccatggttatccctccactatatcgcctctaaaaaacttgtgccgtttgtttagctgtttcaatagcttcctgcataatcacgttagctttttctggcgaatgatcaattccttcgatactaattttaatgacttcgtcaacaccggcgaagccaagaattgttttaacgtattgtgttgcaaaatcttggccagcataaacgcttccggctgactgaatatgaactgcttttttcccagttactaagggctgcggagctgtttcagtatgtctaaatgtttttccagccaccatcactgtgtcaatccacgctttaagtttcgtcggtacatttaaattccaaagcggattaacaatcacaaacttatcggttgctaagaactggtcggtatagcgattaaaccgagcgaccttctcttgctgactagcgcttaaggtggccatagcttgcccttttttaacgccgcccatgccgtcattagttcttgatcaatttctggtaagtcagattggtacaagtccaaccaactgatttcatcagctggattttgtttttgataaacttgcatgaactgcgccaaaatcgttaacgtccgtgactgttctgtagcaagtggatgcgccttaacaactaatactttactcattaatttccgccccttagtatttaaactttatacactatcgttttagtatactatctgcggcgttgtccataagctttacatcatttaataaacaaaccacctattaatgaccttttacaacgttttatacagcaacaaacaaccaaaaacgattaataagtcataaatataccgcaccatcgttcgactatcaattcgagtgctcacccaattgcccaacggaatcacaactaacaataatggtaagctaagtcccaatagttgcaatacttggatggtccaaaagcccgctagaatatgactgattacaacgattgtcccaacacaaataaaatgggcctgtagaatgccccttaacgatgctactggccatttttttaatgtcccataaatcaccaccggcacaccatgactattgtaggcactgcccatcacgcctgatattatcccagctaaataatcccaatgatgtgactgtaaatgttgctgctgcacgtgatgtcggtgtaactgatagcgattatagctgccataaaggattaaaaacccagctaacgttctcaacacaatcgtcgttggcacatacgtcatcagcgctatcccgactggcacacccaataatgaaccaatcactagtcgtctgacaaccgctatatcaatctgttggcggtggcgaatcacagccggaatcgccacaattagtcccagcgcgccaatcaaagccgttgccgcttttaaatcaatcgctattagggccaataatggcatcgttactaatgcctcgccaaacccaaaaaccgttctggtaaaagcgcccaacgcaacgatcaaaagaatcataattattgtcatccagaaatccttcctaaaccgttttgttccacacaaccttttcaaactgcgtgccgttactttttagtacggatagacttgcattagcaaccattttttgtgatcgaatttcctcaaacggaatccctagtagtgtgttgataacaaacaataaaataatcccatgcgcaacaactaatacatcaccatcaggatacgtcgtttgagcagtcttaatcgcgagcatcccacgttctaagaccgcctggtaggactccgcgtgaatctgtttggcatcaaacaactctggatgatggaagtaattttcatattgtggatggttcgtcaaactagcaccaggttggccttcccaatcaccaagtgccatttcttttaaatcatccacgaccatgattgccggttgtgattgattagtctgcgacactatcgcatccattgtttcaacggcacgtgttaatggtgacgtcagtaacgcatcaaaagactggtccgctaataaactacctagtcgtttagcagccgcttgccccgcctcagttaatgttgaattcgtcccaccaccattgaaacactgtgctcgattaaccatcgtttcaccatgccgtacaaaataaaaagttgtcatgttgatcccacctttataggatctatcatactataaaatgcaaaaaaagacgcagttcaaattgaactgcgccttcattgagcctcgttttatttaccttccggcgtgttttctgccacgacttggtcataggcctttgtaccagcatagacttcgtcagttaggatgttgcgtttatacttcatgacacggtaaatgtggagaattaaaactaccacattaatggccagtgctaaaccactgattgtcatcaaagcggcactactgtgcgtactttgcactgagaattgtgaatccgttacaaaagcaggataactcattgtaaacatcatccaaaaagccaatgtttgcgcacgtgcttggagccagctcccttttttaaccaggaatgctgctaatgtacatgaaattaataatgcagcgcccgcatagaatgagtgatcaccaacacaattgtaaacataggcgaagttccaaacatcataggcgataatccacggccagatttgatcgggccagatcatgtctttttgtttgtcatgactgataataatgccaaaccagcctgagattgtgatgatgttaataatcccggcagccccattcatgatgttccacgcgccaccattcatgatcacgccgtcgactaagccatgtaggtgtgaaacttgaaaatcacgaatcacagcttccataatattaaacgctaaaattgcgggtgggaaaatcaatgcccacttgttatgttgtaacttagggataaagcgcagcgccataaaccctaaacaacctgctaatgctgagtacactttaacccagtggaaccaagtcccggtactgctaccaggaccagccgtcgttggccaaacaaagagcgttaaaacgactggcaacccaacaaagagaattaatccaatccacttgttagcccgagctgcttcatttaaaaccattaatgcaataaccactagtccccaaactagccaacccattcctgaaatattttgaaataaaaacatatcagtcacctccaaagaaataattgctaattacattcttactttaactgcaagctggcggtttctgtatggtcaattcagggtaaatgtccaaatctaatgattattttgtaaaacatggttcacagtaccatttaacatgcgatgcatgcgctgataaaattcctctttagattcttgtagatttgttacaagccattgcgtaatctgtgtcgccaatgcccaaccataaaaattggcaatttcatctcggaaagtcgctggacaatccacctttaaatcttgaacaacccctgcaaccatgctaaaagcgactcgatacaaaaagcgacttagtaaatctcgattaagtgaatgaaacgtatttaaacagaaataccgattgttttcaatataagttaccaagacatctagaccgacgctccaatcccgttcacgttgatacactgccagttgcgtaacaatttcacgattataaatccaagcaaccaactcattaatatcggcgaaatggtaataaaacgtattgcgcgcaacgtcagcactgctcgtcaattaattgaccgtaatgtgatcgaccggagttgttttcatcaattcttttaaggtatctgctagcttttgcttggtatccatcgtattgccctccaaaaattatctatgattagcatcccatagatagttccgaactgcaatcactaacccgatttgcactccaggataaattgttctatcgttagagagtacaattaacggaggcgacttataatatgcacgaaactgacgacgcttttagggcgatgaccaatggggaatggtactttgattcagcggtcactattcaaaaacgggatgcaacccgccttgccttacaaaaggccagccaaatcttagataacgatgcacggatggccactatccaaaaattactcggtcataccggtagcgactttttcatcgaaaccggttttgaatttagcttcggtgaaaacattacgattggcgatcatttttacgccaatcgtaacgtcgttatttgtgacgaagcaccagtcaccattggtgactactgtaaatttggcccaggagtatcactcttaaccccttaccacccaattgaccccttagaacgtgcgacaaaaaaagaaatttctagtcccattactatcggcaatcacgtctggctcggtgcaaatgtcacaattctgccaggaatcacgctcggcaataacgttgtcgttggtgccggcagtgtcgtgaccaaatcctatccggataacgtaattttagttggtaatccagcacgggtattacgtaaaattcccgctaaataatcaaaaaggactgacaaatgtcagtccttttttaggcttcaattgcataatattcaataatcgtttttaaagcctccgctgcgcgttgatctccaattaacttagtgtaatatgctgtaaatcgctcatctgctacatacatggctgctaagccgcggtgcattgctagactataccggggggtgtcgctgtttgtaaccacgtttgatgggcttcaaaggctgtttgcgccgcttctgatggcaattgcggctggtccaagtaagtttgtaatgccgtcttcaatcgggcttcagccgcctgcatcgttgcatattgggcctcacttagccctaaaaagtgctgatcggcttcttgcttggcttgtttcccatagttagtcgtcacttcttgcccgtagcgttgctcattttcagccaccgcctgttgtttaaactgttcgaatttagtttgatctgtcatttgaatccctccggtttgattttgaagggtcgcatctagctgtgctaacgttgccgttagcgcagcttgttgtttaaccagttgttcccgctgatttgctaagcgttccagacgctcggccggtggtaacaccaacagctgctgaatctcagccagactaaactgtagttggcggtacattaagattaactgcagtcgatctgcatcctggctcgaatacgttcgataaccattactagcaaccgctggcaccagtaaaccgtgctcgtgataataacgtagcgtacgctcagaaaccccggtcaattcagcgaaagttttaatctgataatccatttgccttccctccttcaaaacccactataaggcctgacgtgacgtgaaggtcaagcattgttcgttagtgcctgattaatttctgtttaaccaagtaatcatgggccacatcgcgtgctttgcggtgtttgacctgtacttggtagttcatctcttgcatttggctctcagtaatctgacctgccaagcgattcaatgctttgacgacttccggatgcgccttggcaaagccggctttcataatcggtgccccttgataaggcgggaagaagtgacgatcatcttctaaaacaactagtttgtaccgtgcgacttccgcatcggttgtataaccatcgaccacatcgaccttgccgtccgcaatcgctttatagcgaatacttggctccataattttagcatttaaatttaattgataggtgtcctttaacccttgatacccatctttttggtgataaaaatcaggatcaaaaccggccgtaaatggttgattcaaagcggctaaatccgaaattgttttgacattatatttcttggcaaaggccgcagtaaccgccaagtcataaccgttttgatagcgcattggcggtaagtacgccatattgaactgttcttgtagcgatgtttttgcaagttgatacgttttagttggattctggtttgtcttagttggcgacttcaccaacgtctgtaaaaccgttcctgtgaattcaggataaatatcaatcttatcagccttcaaggcgttaaataagaatgtggtcccaccgaaattaggtttaaccgttactttgtagttaggctggtcttctaaaattagatcacgatacatattcatcaagatttcgggttcactacccaatttcccagcaatcgtgatggtggtctgcggcgcttgaaaccgtgtcattccttcgatcacaccgaaaaggccaacaaaaatggctaaactgactgtgatttttttaaaggataatgtccctaaccagcgaattaatgcactgaccactaacgctaaaaccgctgaaagtgtcgccccaaccaataatagtgcgttattatttgactgaatcccaacaagaataaacgtcccgaggccgcccgcaccaatcaaggccgccaaggtagctgtcccgataatcatcacgagtgcaatccgcaaacccgagataatcaacggcatcgcaagtggcagttcaatccgtagtagccgtttagcgcgcggcaacccgaaggctatttctgcctcttttaatgctggatcaattccgatcaaaccagtgtatgtattttgaaaaatcggcattaaggcataaagtactaacgtaatcacagccggaatcgtcccaattccgacaagcgggatcaataatcctaagagcgccaaagacggaattgtctgtaagacactcgtgacttgcagcattgcttcagctaatttctgatgagctgttaaaacaatcgccaacggaatcccgatagccgccgcaattaataacgccaataacgaaatctccaaatgttgcccaagtgcttgtagcaactcaccggattgggtcgttaaaatttgttcaatctgttgcatcatcgtcataccccccgtttcgcaatgagcgttgttaaatcggtcatcgtcaattgccgttgttcttgaccatcagtggcaactacgcccccatctggatggtctactaattgttgcgctaattcagctaatgttgcactggacgtaatcgttgtcggctgattattaacaacagttcctaaatcggccgccaataaatcttgaactgtcaacgttgcttgttggcgttcaatgtcaaaaaattcgcggacaaattcattttttggttgattaaaaatcgcttttgctgtcccgacttgctgaatactgccttggcgcattaccgcaatttcatcgcccaagcgcaacgcttctttcatatcgtgggtcacaaatacaattgtattatgcagctgcttttgtaaactcaaaacgagatcttgtaattgtgtacgggtcaccggatcaagcgcactaaagggttcatccatcaaaatcaccttaggactagttgctaacgcacgaataatcccaatccgctgctgctgtccccctgataattcgcttggataacggctagcatactgatccggatctaaatggaccatttccaaaagttcgcgtgcccgtttttgacgatcagctttggtccatttcaatacctctaattgaatggtaatattttcctcaattgtgagatgtggaaacaacgcaatgttttgtagaacgtaaccaatattgagccgtaacgtttggagatccatttgattgatgggttggccgtcaatcttaattgtgccactcgttggttcaattaaccgattaatcattttaaccgttgttgtctttccgctaccactcggtccgaccaaaacaaatagaccattgtctggaatggttaacgtcaagccatctaatgctaagctttgttcatattgcttagtgacaccttcaaattcaatcatgtgctactcctttttccggttaacgatttgttaacttattgtaccacttagcaatcagcccaccaattgacgtgcttaaacacccaatccaatttttttgattcgctttgtgactatgctaagatgaacccgaattgaaatctgaggaggtcttaatatgcaaacacactttgatacaatcattattggtggcggtcctggcggcttagcggcggcttacagtctcgctgaacaacagtccgtcttagtcgttgaaaatgatttatggggcggcacttgccccaaccgtggctgtgatcctaaaaaaatgctttattcagctgtcgaagcactcgacaatcaacaagcgctccaaacaaatggcttagtcggaactagcgctattaactggtctgaactgatggcctttaagcgatcttatacgcaacaaatcccaactggtaccctcaacggtctacaacatgccggcatccaaaccgtcacgggcaccgcccacttcagtgatactcaaaccttgcagattaatggtgacacttacactgccgaccatttcatcattgcgaccggtcaaacaccaacgctccctacaatcgagggtcacgatttactacaaaccagtaatgaatttttagacctcgatcgtttaccagaaaaggttgcctttattggtggcgggtatatcgccattgaactggcaaatattgcagttactgctggtgcagaagtccatattattcaacataacgagcgtattttacgcgacttccctgaagttttaacacataaactcgtcaccagtcttcaggaaaaaggcattcactttcattttgacactgacgtcacaacaattacgcaaaccagcaatcagctaactctcagtaatcaagctaattttaaactgacagtcgacgccgcttttgccgcaatgggccgcaaacccaatatcgaccaactggcattggaaaaagctggggtaacagcgaaccagcatggcattcaagtcaatgaccatttaatgagtagtaatccccgcgtcttcgccattggtgacgtcgtagatcgtgtccaacccaaattaacaccagttgctggttttgaaggccgctatgtcgccaaccaactactcgctaaaaagacagcacccattacttacccactcattccacatacggtatatgcaagcccacaaatatcacaagtaggcgtttctgttgcaactgcacaagctgctcctagtcaataccgcattaatcaacaaaccgtcacaaattggtataccttcaatcgtattcaagaatccgacgcaatggtcatcaccatttttgacaatcaaactaaccaactcgtcggtgctgcggcttacaccacaattgctgaagaactcattaattactttaccaacctgattaaacatcagacaaccgcaacggaactcaccgataccatctataactacccaagcccggcgagtgatttaaaatattattattaaagagaaaaagaaggctgatttagtattatctaaatcagccttctttttatcgttgtccaaccgtgtcggtaaccccagttccttcccgatattcagagggtgtcatcccagtttgttgtttaaataatcgatagaaatacccatgattctgatatccaacaaatgaggcaatataattaacatcataatacttagcattgtgcaacatatccaacgcaatattgattcgataatcatttaaatattgtgaaaaactccgacccatatcctgtttaaataattgtcctcaatagactgcgtttaaatgcagttcctgagcaaccgatcccagagatagtggttctgcataccgtttttcgacaatctgacacatcgccgcaacatttgctgtcaaatgtcgctgttccacagtattggtttcttggaaaactttgataatggctctttcgatttctgaaacaacagttgccttattaatggctgcaattgctttggtttttgtttctgatttcaataatttttcattcaagactagcaccacaaccaatgcaaactggcaaaccaatatatcagaagcactggcattttccaaccatttagtttgtgccacaaaccattctttaaacacaggtaaatcaaagcccttggtggcctctttaacctgtgaataccccggtaaaacgacagccccttctgtttaacggttacgctgaaggtagtgcttggcaaaacggatttgccgtctatcaagatatcgctggacttgctcaactacacggggggcagcaggctttctatcaaaagcttgtcacactggtgaatactccacctgttttcgaggtcgggagttatggctttgaaattcacgaaatgaccgaaatgagtgctttgaatttcggccaactcgccatttccaatcaacctagttttcacatcccatatctattcacctatgtcgatcatccagaaatgacgcaactactggttaaacaattattaatgaccgcctttgcaacccgcccagacggcctacctggtgatgaagataacgggtcaatggctggctggtatgttctatcggcacttggtttttatccggtgaccccaggtagtgcagaatatgttttgggaatgccgctatttgacaaggtgacgctcaaactgcctgacaatcaacaatttgtcatcgagaccacgcaaaatgtcgatcatcacttattcgttaaagaatggctgttcaaccaacaatcttacaccttaccgtttatcacacatcaagcactgatgaccggtggcacattaactgctcatttaggtttggcacctagtttgagagaaaattcaaaaatgccgttttcaattagtacaaatatgtaaacaaaaaacgtcctctcgaggacgtttttttaatgtcgattacgttcaatatgaactattaaataaattaattcttcttctgtaatcgttaattgatacttacgatcaataaattttacgattaaatctgcaatctgtgtcgcttcaggatatttctgtcgtaagtgttgattcataaaggaatcgctgcctgtcagttgttgattactcaataaccgctctgcaaaaaatttaatgtgtgttattaaacgttggtaactaatcgatcctgtttgaatttgattcttaacttgataacggatcaaactaacaacgtcatccaccaatgcggtcactttcatactatcgtaatcattaatgccctctttttctgcattaataatatgaaaagcaatattagcaatctcttctttgggtaaagtaacgttaaatttttcattgattaatcggactgaaaactcaccaattctaaattcttcaggataataattctgcacttcccaatacaatttattctgaatgtgcatcccattcgataatcgttgtagtgcaaagttgatatgatccatcaaggcaaaggttaagccctcatttaatttctgattcaattgttgtattgcatattgattaatctggcctgttacttcaataacctcacttggcatttcttcaagtaatgccatgacttgttttaactgtggtgctgccacaggtacaaaccattgattgccgatatcgtcttcaacttgcatccctggtttcttaccatagccaatccctttgccaagaatgatgagttccgcatcttgcgcatctgttgccaagacaacacttgaatttaacactttcttgattgtcaggtccattacgcaattctcctcaactttaatgtgttttttaaaactgactcttgcgcttaactacatttatcaaactgtttcaaacgcacttctataaattagcgccgttctctgaaatcactttttggtaccaataaaatgagtcttttcggtatcttttaagggtaccattgcccgcatcatcttcgtctacgtagataaagccataacgtttagacatctgtgatgtccccgcactaactaaatcaattggcccccagcttgtatagcccattaaatcgacacccatttcaacggcttttttcatttcactgagatgcgcttggaaataatcgatgcgatattggtcgttaatcgtgccatctgcatttagcgtatcttgagcgcccatcccattttcaacaatcattaatggtttttggtagcgatcgtataactctaacaatgaaattcggagacccacaggatcaacagaccagccccattcagttgtttctagataaggattcttaccgccgacaactgtattaccacttgttaattccaagttagtctcatcactcgctgataccaatgacatgtaataactaaacgagataaaatcaactggattagctttgatgattgctaaatcttcatcggtcattgtaatttgaatatgattacgttcaaaaaagtttaagattagtggtggataaacacccttcacttgcacatctgcacagaagtagttcattgtgttcttattgaatgatgccaaaacatcttctggcgcacaggtattaggatagtccgttaacttagttagcatacagccaacttgactatctggaatcaattcatgacataactttgtgaccatcgatgacgcaacaaattgatgatgcagcgcttgatattcatcttgttctaggtgctttgactgatcgggaataatcccggctgaggtgaacggatggcgcgttacactgtcgatttcattaaacgttaaccaatattttacgtctgggaaactctcaaaacatacccggctaaatttaacaaaataattaatcacatcgcgagacacccaaccatttagtttcaagcttaggtttagcggcatttcataatgtgatagcgtaataattggttcaatttgatgttgttttaatgtcgcgataacatctttataaaaatcaatgcccgcctggttaggttccacttcatctccgtttggaaataggcgtgtccaagcaatcgacaatctaaatgttttaaaacccatctctgcaaatagtgcaatatcttctttataatgatggtaaaaatcaatgccccgacgtttaggataatccgcaattgatttgtcggtaatcgctttttgaatattctcagtcgttattttaacttggtttcgataatctttcacatcaacgtccgctttatacatcgcaatgtcagcaactgacattcccttaccatcagcatcccaagcaccttccacttgattagcggcaattgcgccaccccacaaaaaatcatctctaaaacccattgtcttctacctctttccttttagattaagccattactgttggtaaatcaatgccttgctgactctgactcgtcacaatcatcatcactgtaggatcaaaaccagctgccttaatttgtgctaaatcaaattttaataagacgtctccttgtttaacctgttgaccttcttgcacctgtgcatcaaagaactttcctgctaactgaactgtatctagcccgacatggaataaaatttcggcaccaccggctgttttcaaccctagtgcgtgttgtgtctcatagaccatcatgatttcaccatcaaccggtgcgagtaattcatcattatctggaataattgcaatcccatcacccaaaacaccacttgaaaagacgctatcatttacttctgttaatgcaatcacttgacctgaaaccggtgctgtcaacgcttcagagccaataacatgcattgctttttgatcatctgtttcagtaatctttttatcctgccatagtactaatcctaaaataaatgaaaggataagtgagattgcaaagccccacaacgcatgaactaagtttgctgcgtttgttttatcaacatacatcgttaagcttgctaaacctggtccaactaatgcaaatgctttaagaccaacaaagcccacgtatgcaccaccaactaaactactagccatcacgctaatcatggcacgcttgttttgcaaggtaatcccgtagagggccggttccgtaattccgaataaagctgaaatcccagctgaaattgctgttgcccgagttgctttatcttttgttctgattgcaatcgcaaaacaggtaccactttctgacatattgtgtgctaatgatgctggtagatacaatagctcactcttaatactactcattgatgaaacaacatacgaaatcattgccttatgcatcccagtcgcgaccatgaatggcagaaccgctgctaataacgccgttgcaacccagccgaaatggttaaataaaaataaaatcacagcagtgaaaccttcaccaaagatataaccggcagggccgagcactaataatgtgactggcactgcgattgccatacataataatgggacgaagaaaattcgaattgctttagggcaatattttgtaatatatttttctaaaactgcataaaataatacacataagatagctggaaacacttgtgatgcatacgtaatattgtgcaccggtaaactcatgaattgagtgcctgccgttagcgccgttgtcatatccggcagaattaatgccgcaacggttgatacagctaccaacacgttaacttttaatttctgcgctgtcgtaatcgcaactaaaattggcaagaaataaagtggagctgttccgataaacgttaggatttgatatgtcgaacttttatcactcatccatcctaacatggcaaacagcattaatagtgacttcaaaatcccaccgccagcaatcgctggtactaatggttggaagattccgatgataaaatctagcgctacctgtgtccatttttgcttattttgatgctttttagcatctaacatacctaattcagcattaactgcatcaaacatttcaacaacatcattaccaatgataacttggcattgcccagttgcaatcacagcccccaatacaccaggtactttctttaaggtgtccaaatcagcctgatcaaaattggctaacgtaaatcgtaaccgcgtcgagcaatgaatcagttccgtcacattctctttacccccaacagctttaatgattgctgttgcacttgcttgataatccgtcatgataatccctcctaaaaataaaaaaggacccaaagacacacccatatcatggtgttatcttcggatcctgcctgcataaccagttacatgtccatcaaatatatttaacttaggttcattgtaagcgtttcatttatagatgtcaaactttaattttcttttttcgccttcatctgtaaccagatattaaacgcgagcacaatcaccagtaggactgtcgcaatcagcatgatgttatgcaagccttggtacataatcgcgcgcatcgctggtaataagtgcgctggtaattcgtgaacgcgttggagattgcttaacttattcatcatcgccatcgtaatttgaccgtgcgattcggcaatgccgcgtgttaaggcatggtttaaaatcacaccgtaaatcgatgacatgaatgtttgactgagaattcgcaagagataggcaaacgacgtcgcaatggggacatcgcgttcttcggcatcttcttgaacactgatttgtaggacgttaaaactcatcccgagcccgaaaccttcaaaggcccccatcaacagtaagaaccaaaacggtgcttggtcgcccatcatcaacatgccgctaaacgcaattaaaaacgcaactgttcccaatgtcacaacgcggtgtttacccaatttaggctgaattgcaggacccgccaatgagccaattaagttggtcaccgcacctggaatctgcgtcattccaccgagtagcgcacttaatccaagtagcccttgtgcccacattggaatatagatattaaacgcgataaatgcgccccataaaacaacaaataaaataaagtcggtcaccaattgcggatttttaaataagcggttcggtacaatcggatcaactgcccggtcttcaactctaaacaagacaactaataaagctaaaccagcaaataccaatcctaaaacgagtgctagcgaacccgtcccaatcatttgaatccccgtcaataaagtcaccaaactggtaatcataatcccagcacctaaataatcgacgtttccggtttgatgtgatttaagcgtttctttaaagaaataacgaacacaaacaattgatactagggcaattggtacattgatataaaagacccaatgccaactaaacgtatcgacaatccagccaccaattaggggacctacaattgaagccgcactataactcgcagtcgcataaccaatcacctgcgcgcgtttgcgtaaatttttgtataagtcggcatagataatgaatggtaaagtattcatcccgccagcaccgatgcccatcaccgttcgtgcaatcagaaagaagacgatattccccgaaaccgcctgaaaaatcgaaccaaccgcaaataataatgtcgccagctggtaagccccacgatttccaatccgttcgcctaatttactccataagggggtcgcaaccgccatccccaaaaggaaaaccgccacaatccagcccatatattgaatcccgtgtaaatcactgataatagcaggcaaagccgtgttgataattgtcccatcgagtcccgccattgtgttggataataataatgctaatgttaccaaaagtgtatttttcttactcacgattgcgtgctccatgtatttttcttttatatttattatagtataagttatttcgtttaacgagcttacttcagtataccaatcacttttaatatcataccttatcatatacattttcacacaaataaaaaagacgccctcctcaggacgtcctctaactttaatttaatgcgtcaaactgttcgactttttggcgagctttatcactccgccgcatccggataccatattccgttaaaccaatcacaacagcgactatcaagagaatcaataaactcttccaatcttgcttcaaaataagcaaatcgcccgcaaaggcgtagataaacgcgacaatcgttgaacccccaaagcacgccaggccctgtgctcggggggtgaggtgggtgtctccagccgccaagttgacaaaggccgtaggaatcatcggcactgcatagccaattaatacaccaagcgctggatgttgcatcttaattaatgcgcggtaaacacgcgaatccggctttttactgcgatgatttctgacacgggcaaataattggacttgcaacaagttcccgatcgtcaagccaatcgcattgaccacgaaaccaccccaatgacccaaacacgcgccaataatcaatgccaccgctgatgttggcgcacccggaattaaggtgaccccaatcattaacagaccaaacaccaagaaagcatacggccccagatgacgaatctcaagcacatattggcggtaattttgccattgatccaagaaagcaaaaacggcggtctggtgttgccatccaattagaagaatcactaatcctagtaaaatcacaccgcttgctagccaaagtcgtttggttaaaatcaatttctttttcgaaggtaaatctttcttctttagatagttacccaatgcaattaaagagattacagcagagaaaattaatgcttttaccattggtcccaaatacttccaatagctcccgtcagacaaccgccaccagctgcaccagctacagttcctgcccctattcctttaccaatgtcttttagacaatcttttgagctaccctcccattaatcgtttcatttcttgttcgtttagtttttgaaactttcgcatgataaaactccctttcaaatagatttatgctacatatacaaggtaccaccagtttgttctttgtttggctttttatctcaaaacactaaaaaactgtcctgaatcaagagaagtaacctttcctaaattgacatgatagattgggctatttagtgggttttcaaaaacaaattgacggagtctttattactattcatggatatacatttttatttctgatttcctaacaaaacaatcttatccgccttgtaatacatcggatgtcctgccatgctcggttgtagattctcaaacttacatttgacactttcacgcttcataatctcatcattgtcaatcgggtggtctaaggtattcacggtgacttgggttgcttttttacggaactgtccttctaggatggtcaccgaatatttgtacccgataatctcatcggtatagaagtttcttggtttgttttcgcgatctagaatgacctgaccattttcatcagtgcgggtttcggtcgcaaatttcggagtgacctcatctagttcaaaggttgggccaatggctccgaaatcaaaatcgttaatacttaacatttttggcatcgtgttttcttcctttctttgctatacttggtttagaaaattttttaaccgagcgttcgttcacttattgggaagtgacggacgcttttttggtgcgttcttgaataagcggaattaaatcgggacgttgttgctcgctgacgtattgaatcatgcgatcagaaagttcgggggtccattcataattggggcgaatctctaacaaacttgggtcaatcccgacaccctcatgatgcaagaaaaagagtgcctgagttaatgccatgggtccaccgtattcataccagttcaaggaacgatcaaagctactcaactgatattgtcgagtaatagtgggaaccagacttggttttaggtagtcttgccaccaacgacagacctgctttaaggagccgtcagtataaaaggtaagttccgtttgcagaaaacctcgaattaagtttgcgacacattgatcttgtggtaaaaaagcaattgttcgaaagagactttctgccacatcatttcgtgtctcgacttccaaccgaatttgcggagcccgagccagaatttcctcttgtttcgctccgtcaaaatctttggccatttctttggctttgtcgtaggcccgaaacatacaagctgatcctcgaacgccgatactaaccgtttttgcccgttgtttggcatcaaactcgctgtcatggagttgatagcttcgtccttttgagaggaattgcttccgtttcaacttgttatgaagttgttctaccgtgaagtagggcacttcgttgtaatcatccaaggctaaatctagccgcttgatttcaaaggtgaaggcggtttgactagcatactcgtaaaaacgggtggcgagttcttgaaagacattcgccttggggttatacgaaagtaaaatccattcataagtggtacaggcttgcccactcaagacaagggttcctcgctccttggccttttctggctggtgataggtgtagtatttgagaaaaccacaggtgtacacaatatcgtattcttcatgttttaaactgcctgcttgaatcgagacggattctaaactgatttttaataagtcttgaaagaccgtctgataactgacttgatgcaagacggcttgaaaccaatctactttccctagcacattctgggtacttttggtcatttggtcacctcctttagaatttgcgattgttcgcaaattatttttgttgtgaaaaagcttggtagtatcggcttttttcgcatttttccggtagttattagccattatttttctctttataaggtgctattagaaaggcaccttatcctaagccggtttctggtgttcgcaaaagacctgtgcgttccacgcgtccgtaagcctcgcctgctgattggctttcagccatcgcagacgaggcaacggagacggcaaccacaccaacccgacaccggctcctttccttggccccacacccttgtttagttttgataggttaataaccatcttctcaccgcctgaacgctgtacaaaaccatacctgagtccaatcgaatttctggacagccctgaagaacccattctttcaatgtattaacactcacatcgaaatgcgccgcacaatatttttgtttgacgatatcctgttgggtctgtatttcttctaagcgggtttctaacagggcaaagaattgattggtctgatctttttgccaatccaggagcacttgttccaataccgacattcttctcacttccttatattttctttttaaaactaaaagaactataaataaataaaatagtatcttttcgtacactctaccgcgattcaaaatagatgtcaagtatattttaaaagtttacttgaaatactatttagtttattttttgcttgaattttttagggaaagcgcttatgatagacccgaggtgaggaaaatgatagaaaactttggcggcaatgtcgcacgtttacgaaaagaaatgggactttcccaaacagaattggccgaaaagattggtgtacaaaaacaaaccatctccaatatcgaacggggaatccgttacccgacctttgagagcttggaaaaatttgcgacggtctttcatgcgacaccgattcagctctttggatcaccaaaagagattgcggtctcggaaacaacagttattctcgatcgcattgatgagtacgatcaaaaagttcaaaacttgtttactttggcgaaaattttgaatagccatacagtgaaagaaatagacgagacggcagaaaagctagcctttattgaacgtttctttaccccacaaatgcgtttggatgaagatggaaatccgattttggatcgtcatggaaagccagagatgaaaccagtcttctttgacaacttaccttttgaggaaattgagaaaaccgcaaaaaacttggccttcattcaagaagcgcaacagaacaagtaacgaaagttcattcctttcctatgtgccccacacaataggaggaaaattaaaatggctaattttgatcaatatgaaaaaaagaacggagataaagcatggaagttccaagcttatctaggaactgacaaagtaacaggtaaacccattaaaaccactcgaagaaattttaaaacaaaaaaagaagcccaacttgctttagccaaattgcaagtggactttgaacaaaaaggtctcgaaaaagatggaaatgagacttttcaacaagtttatgatttgtggctgtacacttataaaactactgtaaaagaagtaacgttcatgaaaaccgaaattaagtttcgaaaatggattctaccaaaatatggtgacctaagagtgaataaagtgactgtacggatggcacaagaaataattaatcaatgggcaaaagaaacagatcagtaccgaatactgcattcaactgcaaaaagagtatttgaatatgcgataaatcttggcattataacaaacaatccattgtcacatattatgatgccaaaacgtgaaaaacaaataaccacagaaaaggtgaaagcctacaccaaggaagaagtaaaaaaaatttctgagtatcttcaatcaaagagtggaacataccgttctgaatatgataagacacttatgcgattcctattttacacaggttgtcgaatcagtgaggctcttgctttaaactggaatgacatcaacttcgatgaaaaaacagtcactatcaacaaaattctcagtcaaacaaaacacggctataaggtctcttcaccgaaaacagataccagtacagccacaatttcagttgatgatgttaccttgtctttcctaaaaaaatggcaattaaatcaaaaagaatttatgttgcatattggattaaccaatcctgaaatgattttttgcggtatttataaacaaatcataactcatcatgccatctatgtacggttacaaacaattaccgaaaaagttggagttccctttctaggtatccatgtgacaaggcatacacatgctagccttcttttagacgctggtgcatcattaaaggacgtacaagatcgactaagacatgcttcaatcaaaattacaatggatacttatggtcatctaagtaaagagacaaaagtacaaactgttgataaatttgttaaacatcttaatgcttgataatctaatggcattcaatttggcattcaaaaaagatgaaaaagggtagaatccttatacagcaaggattctaccctctaaaaagactattcttcttcttcgttcattttctttactttatttaggaatgaacggcccatcttgttatcttggtattcacttggttcaatgacatctaaatagaattgatcaatgaatcgaatcaaaccatcgactttatcacggcccatttgtgcttcgatttcacggtatttttcaacatagcggctcaccaaccggtctaaaacgtcttgaccttgtttagttaagctcaaaaatttaacccgttgatctgtttgaagatgttcttcaaccacgtacccattttctttcagtaaccgacattggcgtgaaattgctgaacgactaacactcatcgtcttagctaacttactacctgttaagttttcgttagttgaaatttcgtacataattaaaaattggtcaaaagaaactttgtaatttaaactttctccactgacaaagtcgcttaaattgctgacaatccaccgataaatcaatgaaagatgcgttactacttcccaatcatcagaatacttgcttgttgcttttgctgtcataaccttttctccctttactaaccgatctgtcatgcgtagaaacaattaacggatttaatttattttgctatcaatatattagcatattttgagagaaaagaaaccactcgattcattaaatagctataaatagatttgatgtgcaacaattcaattgaccatataatcatcaacccactatattagtttgtcgtgactatataaaaagaagtcattaaagataaaattattttcatccttaataacttcttttaataacatcttataggttacgatccatattgaacgtcaatttcgataaattaatgcccgacataacgagttccccaatcatcgaggtcgcttcagtcgccatctgcttaacaatcgcatggttttgctcagtcaaatactccgttaaggcagcgccttgatacttttgtgcttccacttgaatggcttcaatcatcgttcgcaattcttgcttacaacggtttaagtaatctacattgccttgaatgtgctggctataatggccttccaccaatactgaaattgtccggtataaccaatatgcactcttcatatcccatttcattggtgtttcgctgaaacttagatccgtatcgttcgcattcgtgaaaaatggaatgaacggtgtatacgttggcatccccattgtgatccacatgatggccgcttgttcctttggcacatcattccgtaattgtaaaatatgtgcattttgcgtccgattcaaaccgattgggcggtaacgatacttgtcggcatcagtcccatgccccattggatcgaatggcgtttcattataatgtgagcctaacaacatttcaatatcttcaacactaattttatgttcaatacgccgaataaatggtaattcagccgattcgggtgacatatcaaaatcagcatcaaataaatgatgggcgtaccaaacccgtggtgtattatagtgccggtctttttcattcatcgtgccaaaaatgtggcggaaattccagcccgttttatccggattcaaatgatgggcttcaacgtattcttgaatgccttctgcccacataaaattgtcggcatccgtgaaatcaacttgttgaatcgccacttggttggcggcaactgcataagcatcatctggaatccgttgtgctagccataaatgccctgtcacaatttccatataccacacttcattgtgatcactaaagagcacactattgccggcgggtgagccgtattgtttaatcaaattaccgagatagctgaccccttcgcgcgccgagttaatgtacggcgcaaccatagcttgcatgcaatcttcatccaacccgtctttcaccaatggatcataagcgagggctttttcatttccatatgtactttcggtacagctcatcgccacgttaacttcgttaatactactttcatcataataaccattatgtttgtaatcaacattcggaacagcgggccatcggtagccattctcaggtaattcggcttcaaacccgtttaaccaagatttaattttagcacccttacgccctttaacagctggattgatgtgaaaccgttgtggtgttaaaggtaaaaaagtatcgtcgttacgcgcaatcatcgttgatccgtccaatgatgcgtttttaccaactaaaattgatgtacatgctgattccataagttgcactccctctgatgaccactttaattgaactcatcggtcacgtttgattaaaattttctcataattaatatccatagtgtacgcttctcacttgcgaaagtatagcctgatttgttgattaatttcctttaacccccgcatttattgcgatttctatacaatattggatttcacgttaatttccgatttcggaattatcgtcaaacgaccatgttagcgctcctaatttcatgatatattattagatgaataactaacaacaaggtggtttctcaatgaaaaaattaacacttgctctgttgctgaccatgaccagctgtttcatgattctagctggctgtcagaataaaacagaaattccagctgccgcaactaaaacagaagaaaaaattgatcaatacgtccaaaaagtgaaccaactctatagtgatggttcccgtaaagatcctgcgaagttaacagccgataaacaacaccaaattatcactgcggctgacaaactcgacaaacaaatcacgcccaacctttatatgagcggaattagcgctgatgcaaaggctgattacaaggctgcccaaaaagatctagataagattactggtaagcaaccagcaactagtgaatctgaaagtgttgcttctgaaaagcctgctaaaaagaagaaaaagaacaaagttaaaacaagcgcctttttcgataaagatgggattgtcaaagccgatgcacaacttggtgaagaaacggactataccgaccaccccaaacaacttgctgattatcaagaagctaaaaatcaattagcggctatggcagctgtccggaacttatttacagacgacaacctcaagcatattccagctaacctatctgctagcgacttcccttacgtccgagctttgattaataaatcaacccatgacggctttaaagaaaagtacttggcgtatgttaagaacgctgaaaatcaatacaacacttactctaacaatacccaagcggcaaccacgcaaaacacaacaaccgctaatcaagcaacaactaaccaaaacacagctaccaatacacaaactacgacaggctatgctgctaacacggcaacggggaatggcactggtgcaacaactgggacggggacttcgacaacggataccacaaccggaaccgggacgactggtacacaaagtaatactcagaccggtacagatcagacacaaaccggtacactccaataatcttaagacacttcctaaaaagtacgctatcttcttgatatgcgtacttttttgacgttcgcttacgtttagtcttttaatcgccaatatcttaagaaacatgtaacagcgcgctaactattatgtaacatgtttgttactttcagatgctatgctaatcagcgtactaaattaattcaaaattcaaacaacttaaaaaatttttcgaaggagcacaacaaacacatgaaaaaacaaaaaatgacttacttatcttctggaatggttggccttgccggcttagtattgatgggtcttcaaacaaatgatgcccaagctgcaacaaatggtacggttaactacgctgacggggcaacaaccgtttggactagcccagcagtaggtcaaaaacctgctcgttacttggcaactaaccaacaagtaacaatccaagacacaaaacaagtttacggccaaacatggtacaaacttggtaatgacgaatgggtttcaagccaattcattacagccggcgatgcaactgctcaaccagctgcaacaacaaccgctgttaagaacacagtaacagctaacttccaatcaggtgcaacaactgtttgggctgacacaactgctgctcaaccaactggcgaatacttaacatatggcacaactaaaaacgtcattgatcaaaaagatttaaacggcacaacttggtaccaattagaaagcaaaggttggattcctgctagctacgttgttttaaacaaccctaacttggatggtgtcacaccaattacaaatgcacctgcagtgacaccagttgctgcaacaaccactacaactgaagttcaagcaccaactgctcctcaagcaacaacgccggcacctgctacagaaacaccagcgcctgctgcaacaactgaagcaacaacccctgctgctacaacaagtacaccagcagcaacaactcaacctgctcaaacacaaacaacaacgacaactcaaagcagccaacaaacaactcaagctgcaacaactcaacaagcaccacaaacgaatacaacgacaaaagcaagtggtaacgcacaaactgttatcaacgctgctttatcacaaattggtacaccttacgtatggggaggctcaacacctggtgttggtcttgactgttctggtttagtgcaatacgcatacgcacaagctggcgtttcattgggccgtgtcacaactgctcaagaaggtgctggccaacgcgtctcacttgataacttacaacctggcgatatcctcttctggggtggcgctggtgcttcataccacgacgcaatctacatcggtggtggccaatacgtccacgcaccacaacctggcgaatcagttaagacagcaagtatctcaagttacttcatgccttcattcgcagttcgcgtcctttaatcaaaaatatgtatttaaaaagagccacatcttaggatgtagctctttttttgtggttaaacttagtttgaaatatatttattttccatattaaaagaccatccaaaggctgcttttcaagcgacttttagatggtcttttaacattattttgaaaaaattcattataattatttagctgatttacgttccttcaagaagttcaatacagcagctgtttcagcgttacgttttttagcattgttttggttaacaggacgacggttaccagaaacactaacatgtaagttttgtgacattgcgcgtttcctcctttcgtgcatatattctattattctaatctgaattgacttatttttcaagttaactttattcgtcttttggttttctgaaatagtttaggagccaactggtcagcggaacggttgctatgaccccaatcactccgattaatagtgcgagtccctcaccaattaaaattttatggttcacaattttactaattggataaccgagttgaatgaaccacatcgttaatgacaagaagctaccgaaaaaactaaagaacaatgtattaaaagccgtcgcaataattttttcaccgatcgcaatccccgctttaaagagttgcttggggcccatttgtgcgtcgtattctaagatttcgactaaaccactggcaactgcaatactggtctcggcgattgcccctaagctgcccagaatgatcatcatgatactaattttttggaacgacaagccgattgcgagtccaaagccttcaatctcttctgcatcttccgcaccaaagccgtaggtagctgctaactggctgaggggcacaataatgatcagcaagcccaccaccacgattaacgacgtcacaaacgccgtcttggccgttaatggttgcttggtattcataaaaatcgatgttgccagtaaaattaaactcaatatgccactgacaatcaatggttcaaacccgccagctacaagcaccagtgccaatataatcacgacaaaattcaaaccaaggctgaagaaaatcgtcaacccttgccagccacagaccagcactaataagatcagtaaaactcccgttagcaacatcataggcgtctcacccgcactaaccggctggccaacaagctcgttactggcaccgccaaagtaatcccaatcgcactaatcaccgtctgcgtaaaacttaacgtgacagttcgcgataaggtatacgcaattgtgttgccattgcgtagatacaataaaataattggaaaagcatccgccatgactaaaaagaacaacacattaactaacggaccaataatttcgcgaccaattgcgagtcctgatttaaacaattcagtcttcgtaacgtttggccgttcaatcgctaattgctggagtgacgatgaaatatcggtcgtctcatccatcacagcgcctaaaatcccgagcacgacttccgctaagaagaccgttttatacggctgtaattcataggccatcgtttcataatgcaagccttgatcgccggttaatttcaagacggccatgctgagaaacagtgctaggaacgtcgcgccaattgtcgcgccatatgagacaagcatctggcggttgggtcctaatactaaaagtagcgttaaacccgttagaacgaccgctaagccacacataatcggcaataaccaccgtccacccgttatcgcgtttaaatggagtgttaagacgaatgcgacgagattgaccaagacactgattagcgtcatcaatccgcgcttgagcatcattagtaataggagactaaacgtcaacagtgttaagccaacgatgattgtatcgcgcttaggctcgtttaaggtccactttttcaaatattgatcacggtgtaaaaagacttgttgtcctttatagtaccgcgtcgacatcgcttgcgacgccgtatacgtattgcgcagcgtaatcacttgccctttttgcttagtgttcaaaaattggcccgtgacccgctggactacttctgtatcttcattttggtactcatcagtctgtttctcacggctaattgtctggacccgcgttacccgaataatcggttgctgatacaaaccagcatcgaaatacgtccctaatacaccgaggacgcagatgacacttcctattagaccaatccacagccgtttatgttttaccacagtcgtcacctctgttttattctagcgtttctgcgggtgaacgtcagctttttgaggctgatttaatcattatttaagcgactattgaaaattccatacgtaaagtagaccactaagccgatgacaaaccagattgccgctgcaatccaagtgacttttggcaattcaaacatcatcaataaacatagcgctcctgatattaacggtaaaactgggtaaaatgggactttaaacccatttttattcggaatgtccttgcgcttccgcaatgggatgaccccaatcgacatccagaaaaaagccaccaatgtgccgatgtttaccaaattagtcaattgatccagtgaaacgaacccgcctagaatcatgatgactaccgccacaattttgatactgttagttggagtttgatgttttgcagtcactttaccaagtgcttttggtaataagccatcacgaccaattgaatagatgaggcgggaactgctgtaagtcatcgtcaacatcatcgtgaacatccctactaatgcgccaagtgaaatcagaccggcaaaccaattttgatggacgacttgtagcgcgaatgtgaccggattagcaacatccaattcgcggtacgacaccatccctgtgaggacaaacgccactaatatataaagcaacgtacagatgattaatgtcccaataattccgataggaagatttttttgtggattcttaacctctgccgccgatgctgacacacagtcaaagccaaggtaagcaaagaagatgagtgatgcccctttgaaaatcccacttaccccaaacggcatgaacggttgccagttagtaggtttcacgtagaaaatcccgacgccaatgaaaagtagcactacgcctaatttaatcaaaaccatgatgttattaatccgcgttgatgaacgagtccctcgcattaataatgtcgcaatcaaacccactaccagcatcgcaaacaggttcacataagtgccgtgtgccggatcaaacgggccagtaattgcatgcggaatatggatgccaaacccttcgataaatgatacaaaataggccgaccaaccagttgaaaccgccgcaactgacaacatatactccaagaataaagcccagccaagcagccaaccgattaactcaccaaaaataatattgccatatgagtaagcacttcccgcaactggtaataccgatgaaaattcggcgtaacacatcgccgcaaccgcacaaacgaccgccgcaatcataaatgaaatcgtgattgccgggccactatgtaacgccgcaatcgttcccggtaagataaaaatcccagtcccaatcactgcccccacgcccaatgcaattaaatccttagccgttaatgttttggccaaccgctgatcttgttgtaaataacgttccagtgattcttttcgtaacatctttgccattaatcccattttaaccactcctatttttattgtatgcactcgactaggcgattactcgccgcctaccaggcttcgtcgcacttctttaacgtgctccttgaactgccttctgcgcttaactacagaatcacaatggcggtcgtacgcccaccattgcgcttcttaggttatgctcgaagccaaatcgttcaagtcgcacttctttcttaacgtgctcctcagccagatacttccgtatagctacgtccagtaaacaaagctacaacccagctttattcactggactatgctattactcagtatctaaccaggcttcgtcgcactcatttaataacaaaaaaaggagcccactagtcttcactagtgagccccaccaggaagatgactcagggttacccagccatcttccaattcattaaggtttgtcatttcaactcaaatgccttctccttaatcaaccagtcgattactgggtatcttaaagaaaaagctaaaggcaacacgttgcattgaattcatgacagaccctccttgttattaattagttacttagtataggggataaccatttatttgtaaaggattattttaaaagttgttttctaaaaataatctgctagaatcaaatttaacttattcaatggatgtgactggcattgaaaatcgcatgctatttttctgacaactcgattggtacgaactgttcatgcacgtgcgtggaccgtttatttccgattgccgttagagattgcttgcgttaattttcaggtcagttacctaaagacttgttaaaagacgctgttattgcgtctttttttgtgcatttttaacgacaactgggccaatctcattcaatcaatgaggtgataattcatgggcacaattcaattcaaagcactcacatttaactattcagatcaaacacaaccgttgttcgatcacgtcacgcttcaattcgacgccagttggaaactcggtttaatcgggcgcaatggtcgcggtaaaacaacgttattaaaattacttcaacaccaactaccatttgatggccagttggttaccaatctcgattttcaatatttcccacagactgttacagaacctacgcaactcacacgcgatattctaatgcagctaggtaacctcgacaattcaaccttctggcaagtcgagcgggaactgcggctcctacaagtcgcacccgaaatcgtctggcaaccatttgcttcgttaagtcctggtgaacaaaccaaaatgttactcgccttactattcatcgacgactatcattttcaactgatcgacgaaccaaccaatcacctggatcaagaaggccgccaagtcgttgccaattatttacgccaaaaagccggcttcattgtcgtcagccatgaccgccatttcttaaaccaagtgatcgaccatgtcctagcgattaatcgtgccgacatcaccgttcaccaaggcaactaccaaacttggcaaaccgcccacgaccaacaagctgcttatgatcaacaactcaagggcaatatcaaacggctgacaaaaacagcacaacaaaaagcgcagtggtcccacgaagctgaaaaagggaaaaacgccgccagtgtcaaaactgaaagtgccaatctcgataaaggcttcatcagtcatcgcgccgctaaggttatgaaacgggcgacgacaattgccaaccgcgcggaagaagcaatcgaagcaaaacaacaactttttaaaaacgttgaaattgctgcaccactgaccatcaatcagcgacccctcaaacccggtcaaaatgtgcttagtgttgatgaacttgtcttacaacaagacggcgtcatccttagtcaaccactctcattcaccttagaagctggtcaacaggtcgccctaactgggattataatggcgcaggtaaatcaacactgattaaggcgttacttgcattacccgcaactgaccacattaccagcagtagtctgcaccttaatccgcacttaaccctctcgtatcttccacaagatttcgatcaactgagcggctcactggccgacttcgctgctgcgaaacaggttgatcacgaacaactgctaagcatgttacgcaaactgggttttgaccgcgatttatttacccaccgtctagaaacgatgagcatgggacaaaaacgtaaagctgcactggcacgttcgctctgtgaagaggctgactgttacctctgggatgaaccgttgaattacctcgacgtcatcacgcgtgaacaagttcaaactctaattgccgagcaacgcccaaccctcctatttatcgagcatgatgttgatttcgttaacgccattgccacccaaacctacgcacttcaaccacaacactaatccgtattatttgtataccgtgtcacgttatatccgcgcacgttgaagtaagtcgttggcgactcatcatcaaaaaaggccgggttcatatcattaagtcgcgtttcggtattggttaacgtttgttccggcagtgctaaattttcacggagccgattcgaagtagcctgcaaatcttctgtactaatgatttgataggcactgccgttaagccacgccgttttacctagcaattggctgctgacaatttcaccactactttgatgatagttgcgaatcaactgcttcacttggtcggctgtaaaatcagtgctaattttctgaccaagcttagtcattaagtcaccaatgttcatcaaatattttggcttttgaattttttgcgcaacctgtttcaaaacttcttgttgccgcaattgccgcccatagtccccgcgcggatcttgataacgcatccgactataagcaagcgcctgatcaccattgagatgatggtggccttgtggaatcacttgtccattcaaattaacgtcaatcaccatatcgatggtaaactccctgacaaaatcaaccaattctttgagtgcgcccatatcgaccgtcaccgagtagtcaatcgggagccttaaaaactgactaactgtttttttcgccatcttagccttgccaatttcataagccgcattaattttctgaatattaccgccgtggtcatctgccatctctgccaatgaatcacgcggaatagagtagaccaccgttgcttcttacaccgggttaagtgttacaaccatcatcgaatccgacagaccacgatcaacgcgcccatccgcgcctgtgtcaacgcctaataataggaacgagattggctttcgctgatcaatttgttttgaaattcgactagacccggttttaatcgcatcaacagctttatcctcttgatgcaaataaaaacctagcgccgccagactaatcacaacaatactactgattacaatcacgatactgatctttttcacagtcaattcccctttgtttaaacgcccaccgcatccttttttagatatgaaccaataaatgctgtcccccttttgaatcgttcgattctggcggacagcattttattttaacctttgctttaaccgacgtaagccaactagcatgaccggcgctaagtgcgaccgattaagccatcgtagccaccgggatgtgccggttggtaaaccacgttctaaattgatcaattgcgtctgaatgaattgtcgctcaggaacagtcagtgtgcgctgatcaaaaacaattaacattctaaaaaaggtccgcacatactgctttaaaaatcgtgtgtaagctgcgcgatccacttttgcaattccagccactaattgcgtctcaatgatgtgcagagctgttaagttaactgagaaccactgcggctttagggtactcgtagccgcctcagcatgccctatctcgtaaacatataaaaacgctgcccgatgcctaacaactcggcaatgttgtaaatactgcaagttgaaaattaaatcctcaccgatacgcagcgattcatcgaaccgcaatgcttcagcttcaataatcgctcttcgatacaattcattacatgattgaaagaagacattgcttaatttatttgctagcgaaattgactttgcaaatatgttttgtgccccgaagggcgaccctacacatttggtttgtcgaaactttgttcagttttcaaagatctactgtgtcgaaacagcttaattaatatatcatttctaacgaacactgtcaagcgtttttaaatgttttttgaataaacattcaaactgatttaattacctgactcgttagcaacaatgttttatctcgctgacaacatagactactatatcagctctacagcctttcgtcaactattaatctcaactgttatttatgaactttcataatctaaacagtcgctagtatccgcaatttatgcaaataaatgaactattaaacgaacaactcgcgcaaacaacataatataccgaaagttgatgcttattcacccacaaaatacactaaaaaaactttttataatcccaatttttttcaataaaaaaagcccgcaagcaaatcgtctgcttgcgggctttagtttaatcttaatcgttattattgttgtctggacgcattgttgggaataataagacatcccgaattgatgcggcatctgtcagtaacatgactaaccgatcaatcccaattccaagtccgccagtcggtggcattccgtattccaatgcttcgatgtaatcttcatcgattccttcggcttcatcgttcccattttcacgttctttagcttgtgcttcaaaccgttcacgttgatcgatagggtcgtttaattcagtaaaggcatttgcatattcgttaccgtgcataaataattcccaacggtctgtgaaacgatcatcttcagcattcttcttagccaatggtgagatttcaactggatgaccatagatgaaggttggttgtaccaatgtatcttccacgaattcttcaaagaacgcattaatgatgtgccccacttgccagtatgattcatacttcacgtggtgttgatcagctaattcacgcgctgcttcaaccgtcattggttgccagaaatcgacacccgtcttttccttaattgcatcgaccatgtgaacccgtccaaaatcaccatcaagatcaatcgcttgtccttgatatgaaatctgaccagttcctaaaaccttgtgcgctgcaaatcggatgatcccttctgtttcatccataacgtctttataatcaaagtatgcagcatatgtttctagcattgtaaattcaggattgtgtttcgtatcaatcccttcattccggaatacgcggccaatttcatagacacgttccatcccaccaacgattaatcgtttcaaatgaagttcaagcgcaatccgcaagtacaagttgatgtctagcgcattgtgatgggtaataaatggtcgtgctgatgcaccaccagcttgaccatgcaagacaggtgtttcaacttcagtaaagccattgttatctaaatattcacggacagcagaaataatcttgctgcgtttcgtgaaccgatccaagctctctggatttgcgattaaatctaagtaacgttgacgatagatttgttccacgttggttaaaccatggaacttatctggcaatggtcgtaatgcttttgataggaaagtcaggtgcgttgctttaacagttaactcacccatgtcagtcttcataatttgcccagtaatccctaaatgatcacctaagtcagcctttttgaaaattaaatagttttcttcgccaacttcatctttacgcacgtaaatttggattttacctgaacggtcacggatgtcagcaaagccaactttccctttcccccgtttagacatcatccgtcctgcaattgtgacttctagattcttagcatctaaatcgtctttttcaattgcttcgaattcactgtgtaattccgcagccatatgtgttctatcaaaacgactaccaaaaggatcaattccttcatcttttaacaattgtaacttttcacgccggacctttagttggtcgttcatttctctttgattatctttttgtcccaactgacaattcctccatacattcaattatctactaatgttgattttaacacgaaaacaccaacataaggaacctaatttgccattctcgcttcggtttcttctacaaagcggtctaaaatatcgccaacggcttgttccgtttccacttcgttaaccgccgctttggtcttagccgcacgaggaatcccttttaagtaataggcagcttgttgtctgaattcacgacaagccacatttccacctttaagttcgactaaacggtgtaattgtaacttggccgttgcaattttttcccgtggcgttggttcagcaatcaattcacctgttcgtaagtaggtttccacttggcttaaaatccatggattaccgagcgcagcccggccaatcattacggcatcagcacccacttcgtctagcatgcgtttagcatcttgtggtgtccggacatcaccgttacccataaatggaatcgttaattcagatttaacctgttttaaaatgtcccagtctgcttgcccggtgtacatttgtttccgggtccgaccgtgcattgcaagtgctgaagcaccagcacgttcggcagcaagtgcattttcaacagcgaaaatatgatcttcatcccagcctgtccgcatcttaaccgttactggcttcttcacggcgtctgtcacgtatgagaccatttcataaactttgtttggatctaataaccaacgcgcgccagcatctgtcttaacgactttattcactggacaacccatattgatatcaataatatcagcttgtgtatgttggtccacaaatttagcggcttccactaaggtgtcttttgaaccaccaaaaatttggatgctaactggatgttcgttcggatcaacaaacatcatccccattgtcttttgattattgtgcataattccgcgatcactgatcatttcacagaccactaaacctgcgccaaattcctttgcagttacgcgaaatgctgcgtttgtaataccagccattggtgcgacgactacttgatttggaatcgtcacgtctcctatttgccatgtcataatgccaacccattcccttcgtgtcttccgacaatatccaaattatcatagcaaaaaaatagtattcaggcaaaaatttgcgactattctattgcgcggctaaaattgcctttagttctgcttctgtaaattgatattgcttgccacagaaacgacaaaccgcttcagcaccgtggtcttcatcgattaattgttgtaaatccgctggcgcaacagaactgagtgcctttgcaaaccgatcctttgaacaatcacattcgtatttaacaggtattttttctaacgtcttcattgggagttcgcccacaatttcagtgataatttcctctgggctcatcccttgttggagtaattcagacaccagcggcatttctttcagccgcgcttctaagatatcgattaaccggtcatccgcccctgggagaatttgaatcatgaagcccccagcaacaccgattgagttatcttcattaacaaagactgaaacgccaactgcagatggtgtttgttctgatttagcaaggtagtaagtaaagtcttcacctaattctcctgataccaatggtacttgaccggtaaacggttcttttaagccaagatctttcgtgacactcaacgtaccagttgtcccaacaccacctttaacgtcaattttatttttgtcgttcaatggtaggttaacgtgtggattcgtcacataccctttaactgtgccttgcgcattcccatcgacaacaatcttcccgactgggccgtcaccttcaactctgactgtcatcttcgtatcaccttttaagccagcggcactcaataaaagggtgccgacaatcgtccgcccaaacgctgctgatgaagttgaccatgtgtcatgtttttcttgcgcatccgttacaacatcagttgcgttcactgcataagcacgaagttggccatcttctgaaatttgtttaattaaataatctgtcatctaaataacctcttttatggattgatgcaaaaaggtcgaccactaatcgtgtcgacctttttggtgtaacaatttatgcttcatcgtctggatgttgattatcctcagctggtgtcgattgatcatcttcatcaggtgtgattgtcacatcctttttatcagtttctttttctgaatcttcttttgcggcttcttttgcttcaagcgccttcttagcttcttcaaaagtagctgctttttcgcttgggaattcttcagcgttcttttctggcatcttaccatcattgaacaagctcaagatttctttttcgtttaatgtttcgtacttcaagagcatttccgcaattaacttatgttgttcacggtgcgcttcaataatttcgtgtgcttgttgatgtgcttcgtcaataatccgacgaatttcactatcaattgcagatgccgttgtttcggagaaggctgggccttgaccgtaagcagcaccaacgaatggttgaccttctttttcaagggccactgtcccgagcttatcagtcatcccatattgagtaaccatcccgcgggcaatatccgttgcttgttcgaaatcgttagaagcaccagttgattgagagttgaaaataatttcttcagctgtccgaccaccaagtaacccaacaatttgttctgttaattctttcttactcattaagaactgatcattcttcggtaacatgatggcatatccgccagcacggccacgagggacaattgttaccttccgaacaacacgagaatcactaagaactaaaccaatgatcgcatgaccagcttcgtggtaagccacggtttcacgttctttaggattaatcacgcgatcccgcttagcaggacccgcaatcacacgatcttcagcttcatcaacatcagaagcatcgatatcggtcttgctacgacgagcggctactagagcagcttcgttcaataagttttcaagatcagcaccaacgaaccctggggtttgttgcgcaatttctttcaaatcaacatcatcggctaaaggtttgttcttagcatggactttcaagatggcttcacggcccttaacatctggacgaccaactaggatcttccggtcaaaacgacctggacgtaaaagcgctggatctaagacatctgaacggttagtagcagcgatgacgatgacgccttcgttccccgtaaacccatccatttcaactaacatttggttcaatgtttgttcacgttcatcgtgcccaccgcccatgccggcaccacgttggcgaccaacagcatcaatttcatcaataaagataattgatggggctgcttttttggcttgttcgaataaatcacggacacggcttgcaccgacaccgacaaacatttcaacgaagtcagaaccagagattgagaagaatggcacacctgcttctccggcaacggctttagctaataaggttttaccagtacctggaggtccttctaaaagaacacccgctggaattctagcccctaatgcagcaaacttccgtggaccttttaagaattcaacaacttcgactaattcttgtttttcttcttccgcaccagcgacatcagagaaacgtactttattagctttcttgtcggctttttgagctttggacttaccaaagttcatcatccgaccgccttgaccgccaccttgacccgcttggcccatcatcatgtagaataaaccaaacatgatgatcaatggcaatacaagacttaaaatacttacccaccaaccagattgtggttcttgaagggtttcaaccttggttgctgatttgtcagctaacttggtcattgccccaacttgtgaatcactttgtaataaggttgttgtgaagtgtttaactgatcttgcttttgttttttgtcctaaaagattctttttaggctgttctgttttttgtgctttacgatattctccagaaattttataaataccattcgttggttgaattgagaatgacttgaccttattggtcttcaattcacttaaaaatgtacttgattgaacttccttagactctgatccagcgttaccgttcatgaagaacgagaacacaccgactaaagccactaagataataatgtaaaacagactattactaaacagtccattctttttgttgttcatacgtgacctcctgaagcttctcatcatttgtgacacagtgtccttttgacactgttaaactataacatatctgacttttattgaccatttatttacccgaataaatttcaggtttcaaaacgccaattgttcccatatttctgtatcgttcggcatagtccaatccgtaccccacaacgaattcatttgggacttccatcccaacataatccgaatgaactggcacaattcggcggcttggtttgtccattaacgtgcagactttaattgagtttgcttgacgtgttttaagaattgccattaagtaattcaacgtgcgcccagtatctacagtatcttcgataatgataatgtcgcggcctttaacactcgtatctaaatctttgatgattttaacttcacctgacgagatggtctcagcaccataacttgacacatccataaagtcgatttcaacatggaggtcaatttcgcgaatcaaatctgtcatgaagacgatcgcaccctttaaaataccaattaataacgggtttttaccttgataatccgctgtaatttgttttcctaagcgctgattaaccttttgaatgtcttctcttgaatataatacgcgttcaatatctttttctaacattgtgccagcctccgtaatttgcttaatcatctaaataacatagtatgtaccgtattttaccagtttgttcgcgattaaacaacgccgaaatccgtaaatccggccggccaagcaattgatttggggtccaaaccgcccatgcattttggcgctttgcctgtggggttttagtatcaatccataaccgttgaatggttttgtggtgtgccttatcaagcattattcgatctgttgcttgtagcgccctgagttgcagtggccagtcctctggtgctaaccaaacgacctgttgccgttgaacttgattaggtagatggtcgatatcgaaaacaccaatttgttcgccattttttaaccgcagccattcattaatcgctaatgttcgtgttttgaccaaagaatccactatttggtggacaccaatccgaaaacaccgatactgcttttcaaaaatgatgccattgttcaatgccacttggccttgcggtttctgcgggttcgccaacaattgttgcacttgcattaactgggctgcctttaacgccggtaaagtcttaaaatatcgctgccacaccaattgccagagcgccctttgttgtgtctggttcaagccatcgagttggtctaaacgcccttcaattgccgccggctgttttttgattgccaacaatggcagtaacgccgcggttagatcatcttggtgtgccaccatttgggtcagactttgactgaaccgattggcattttgaatcaagtgtggattttctcgttttaaaagtggcaccaccgcatgtcgcatccgattacgaagaacagttcgttcctgattggtttgatcttcgtaatacctcaaaccaatctgatcagcgtaatcacgcagttgttgcttactaaaaggtaatagcgggcgaattaacgtccccgttttaaacggtctgacttgccgaatcccccgcatttcatgcaattcaccgctacgaactaatttcatgagcaaggtttctagttgatcgtcgccgtgatgcgcggtcaccaagtaatgcgccgattcggttcgcatgacttgatcaaaaaaagcatagcgaaattgacgtgccgccgcttcaacccctgtttcaggatgactcgcttttggccaatgttgaatgcgtaacgggatggcatgcaatcggcaaaactgggttaaatatttttcttcagccgtactttgcgcacgcaattcatgattaacgtgagccacaacgacttggggtcgttgtttttggggcagatgagtcaataaccacaataaaaccattgaatcgactcccgttgacgttgccaccacaaccttgtcgccggcttgccagaactgctctttttgaagatgtgtttgaaatgcttgttctaacataccgattcctctccaacacagacttgaaatgaaataaaggttgccccgaaagtctatcactaaactttcaagccaacctttatcaatttgttctattaactgcgacggccgccacggccaccacgtttaccttctgtattccgtttaatcgttgataagcgatcttcactatcttttaagaaccctgataataaatcatcaaagccttcttttttaggtgcgcttgaatgctctggtttgcgatatccaccgcgattattatttggacgactttgagggcgcggatgttcttgcactttaggttgatcaacggctttgcggattgataaaccaatcttaccgttttgatctgacataaccttcaccgtgacttcatcaccaacggttaaaacatcatgaatatctttgatataactatcggacacttcactaatatgtaccaacccggttttgccttcacctaaatctacaaaagcaccaaaattcgtaatgcccgttactttaccagcaacttttgaaccaacttcaactgccatataaaactacgtcctcctaaatggtcgtttgaactcgtcaaacttttaatcacttaagcgtgatatttaataaaataagtatagcacgctttgcccttgaaacaaggtcgtattctgaattatttttgttgctaatttaaattaggcgccttgtcctggggcaaactgaagatggtttcaccgtctttagaatagtaatacttgtaccgaatgtatttggccaagtaatcattatcatgcagctgttgcacttgaatctttaaatcagattcagttgctttagctttttttaatgtcttttctttagctgccgttgtttctctaatctcggccaatgaatgatgggtttggaaaatctgcacaccacaaattaagacgactaatactgcaacaatccccaagccacataagcggcgtttatgaacacgcttaacatgggctgccttgtcttgcacgattttctgggctgcttgttgctgggtaaatgcattctcgattttcgcaatttttcgactcacttagaagccccccatctcggaattaagttcattatagcaatttcacaaaaaggtcgtcaactaagatcccagattcttaatgacttttattaagatgctcaacaaagtcacaaaaaaaagcaccggcccatattaattcggccagcgctttttccttaatcaaagttttcagcttgtcttgtttccaaaatttcatacatttcagctgcatcgcttttcttcgtagtttcgatgatctgtgtgatgcgtacgaccatcgttttattaccaaatccgatttccagtttatcacccacgatgacattgcttgaagattttgcagggcgatcattaatcatgattcgacccttgtctgcaatttctttcgcaactgaacgtcgtttaatgattcgtgatactttcaaaaatttatctaagcgcattattttgtcctaccttttatttttttcgaaaggcgcaatagttgccggccacctggcatcgtcagccattctcgaatcgagaataattgccaccgtaatgctaatccgccaaataggagcacaccaacgagtacgccaaggcccgtccctaaaatcacatgtcctctggaactaagtgattgtggtgcaaactgtagcgcaatcttaacacccagccacatcactgcacaaatcgcaagtaacttaccggtaaagcgttgcaaaccaagcgcttgccgtacaatcactggtgattgccgtaaaattaaggctaacacaacaccgaggctgataacagtcccgacactcgcgccaacaatttgatagtgttgcacaagccattgattgattgctactttaacgattaacccaacaattaaggctgccgttgttttatggaactgatcaagactttggagcaccgagttgcaagcattgatcagcgcgatgattgcgatactcaacatataccaaaccaatgcctgattaccatcagcatccccgaataagaaataattaatctgcggcatcaaaaccattaggccggtggttgctgctgccgataaacctaaactgatatgaatcagcgcttcagcaacttgttgaaattgatattgttgccgccgttgccgcgcttgtgacagactcggaatcaacgttgatgagaaggcaagtgacacgactaatcccagctggacaagtggttgcccacggtcaaaaatccccttcatattcttagcaagttcttccgataatccactgaggaccaacccttttttaactgtaaaggaatcaaccagctgtaataacacaattaatgaagcaaagaggcaaattgacccgccttcaatcgttaagcgttttgccaattgttgatacgccttaaaatcgatgccaccacggtgtggcgccttgagttgaaaggcggtttctgctggccgtaataaaatataggttgcaaccaagccgccaaagaaggcgcctgacatcgcccatgtgcccatttcatacactgaccagtgcagtttcaaagatagccacgctgccgccaagatgaccacgacccgcacgagttgctcagcaacttgtgaaaccgccgtcggtaccatattgaaaattccttggaagtacccccgcgtcaccgctagaaacggcatcaataaaaacataaacgataccatttcaatcagcggtgttaatgctggatccgccatcgcccccgcaattttcggcgcttgatactgtaaataaatgaagattgcagcaccaaagatgcctaacagtgcaaatgagcgtcttaacagctgcgtttgttcctccggattgacttgttcagcaaccagtttcgaaatataaactggaaagccactaagtgcaaacgtcatgccaatgccatagattggatagacttgttgatacacgtaaaagccggtgttaccgaccatattttgaaatggaatccgataaacggcacttaataccttcgcgataaacgacgcaattgataaaacgaccgcgcctttcatcagatgttgcatctgtttattttgcatgcctggcctccacttagcgtgcctaatccgttggttgttccgtgtgcttttgttctatcttcaagagacttgtaacaaaagttgccacttcactcaaccaatctgccggttgcatcttcggctggattacgagtttcacgcttaattgttcttgttcaaacccgaccgttgctttcaagcgagttgtcgataacgcttcaaaaatttgttcacctgaaacaaggcgactgcccttcgccgataaggtgacttgaatgatttctttcgtttgtttgatggtttcgattaacgcgtcatctgcattcatcttcaactgaccaatcgctaataaattagcgacttgatctggataatcaccgaaccggtcaattaaatcggcctgaatttcatcaaaggccgcttctgaatccatctggcgaatccgtttataaatttcaattttttggcgttgatcattaatatacgcgtctggtaagtaagcttccagtttaagatcaatttcggcattcgttttagcaacgacttgcttcccttgtttcttagcgacggcctcacccaacatttgcgagtataggtcaaacccaacagaatcgataaaaccatgttgttgcttacctaataaattaccagctccccgaatcgataaatcacgcatcgcaattttaaacccggaccctaattcggtaaagtccttgatggcctgaagtcgtttctcactaacttccgttaaaaccttatcgggtttatacataaagtaaccgtaagcaatccggctactacgtccaatccggccgcgtaattgatagagctgtgaaagaccgtaatgatcagcatcttcaacaatcatcgtattgacgttaggcatatcaaccccggtttcaataatcgtggttgtcaccaagacgtcgtatttaccttggacaaagtcgtagatgacaccttctagttgtgcctcggtcatctgaccatgtgcgaacccaaccgttgcttcaggaaccagcgcttgaatctcatcgaccgtgcgttcaatgtcactcactcgattatggaggtaaaacacttgaccattccgttctaattcccgttcaatcgcttcgcgcatcgcaccggcattttgttccatgacatacgtttggataggatagcggttagtcggtggcgtttcaatcacagataaatcacgcacaccgagcatcgacatgtgtaacgtccgtggaatcggcgttgccgtcaacgttaacacgtcaacttgtgccttcaactgcttaagtcgttctttgtgttttacaccaaagcgttgctcttcatcgacaatcaacaagccaagatctttaaacttgatgtcttgcgataacaagcggtgggtgccaatcacgatgtcgactttgccctctgctaagcctttgagcgttgccgtcacttctttgcgcgttttaaaccgtgacagtaaaccgatttcgaccgcgaaatccgcgaagcgtgtcaacatgttttcataatgttgttgcgccaaaatcgttgttggcactaaaaaggccacttgtttaccggcttcaacggctttaaaggctgctcgcaaagcaacttccgttttcccaaagccaacgtcgccgactaataatcgatccattggacggacgcgttccatatcatgcttgatttcagcagtactgcgtaattgatcatctgtttcaggataggggaactggccttcaaattcagcctgtaattgatcatcttttggaaaggcgaagcccttttcagcctcccgttgcgcataaagttcgattaaatcatcggcgatatcttcaatctttgccgaaactttactcttagtcttttgccattcgccaccgccaagcttattaatcttcggtgttttagcttcggccgagacgtatttttgcaccatattgagttgagtgactgggataaataacttcccattatcccgatacaagatggtgatgtagtcttgatgaaccccatcgacttccaaggtttccatgccgacgtattcgccaatcccatgattgacgtggaccacgtaatcacctggttttaattcgttataactctttaaccgttctgcattggccaaggtttgccgccggacttttttcttcggcgccgtattgaacagttccttttcagttaagaccaccagttttaaatccggtaattcaaagccattttgaagtgatccttgaatgatttgtgtccgccccgtctccaactgagtcttattggcgatgacggcatcaatttcaaagtcgtggaacgtctgatcaatcttcttgacccgtttaggatcagacacgagcacaatgaccgtttgtttttgcttttgccaatgcgcaatctcggttttcaaaagcggcatttggctaaagaattgttgcaccgtccgcgtgggtaaattgttgagtgcatcgagttttaactttcccattcccttttggaacagtgatagatagagatgcgcatgtgtatcttttttgatgagcgcttgggcatccatcatgagtcgttggtctggcaacatgcggtgggtttccaacatatcggtttgccagttggccgcttcttcagtcaaaatccgttgcgtttctaaaatgcgcggatagtcatcaaaaatcactaagccactctttttaaagtaatcaatcagacttgattgatctggatacagataatcaacaaacaacgctaagttctcaacgcgttcaccggccaacaaccgttcaatcggtgtttcaaagtttgtcgccaattgtttttgttcagttttatccgttattttggccgcaaccgcctcataagctgcttgtaatgcctcaccagccatttccaattgtgctgtgttggccaataagtcagtcgccggcataatttgaacactatctaaattctcaatgctccgttgcgtatctgcttcaaaagagcgcagtgaatccacttcagtatcaaagagttcaatccggaccggattttccgcatccagtggaaaaatgtcaataatatccccccgcattgcgaactcaccaggtttaccaaccaacttatctcggaaataacccatttcaccaagttgcgcagcaagtgcctggggatcaacttcactatcggtattgattgtgagttgactatcttgccactgacgtgctgtaggtaataaccgccgcatgcccgcaacagatgtaatcacaattccttttttgcctgttgctaaaaaactcaacgttcgcacacgttccgctctggactcaggtgaactaactgccatttcagccgccatcacttcttcaactgggaaagtgtaaatctgatcactattgagtaaattactcaaatcatcagcaacttgattggcttggaacgtattactttcaataatcaataagggctgtcgttgttgtttataaatcgtcgccaaaaacagggttttcgctgatcccgaaagccctgtaagtagttgtttaatccctggtcgttgattctctaaaacggattgcacctgttgggtttgccccagcattgtcattaaatccatgtaaaagttcctttactttcttattataatggcgcgaagaaacgtgctctttacggcaacttttttcgtctagttgcgtctgccaaacggctaacaagttggtcattcgccattctgtgttaatcctcaagggataaccggcttactgcgcactctaattaaacttattcatcgttttcatgaagtcgtcgttttggcaccagtcttctagtgcttcgcatgcctggtctagtgcttgattgataattggtgcgctgtctttgtcaaacggcgttaagacccagttaacgactgtacttttttgtggatgttgaatcccaactttgacacgcttaaattctgagctttgtacacttgcgatgatactcttaatgccgttgtggcctcccgctgaacctttttgccgtaagcgcaacttgcctagcgttaagtccatatcatcttggataactactaattcatctaggttaacttggtagtatttcattaaaggcccgactgaacgaccggaatcattcataaacgttagtggtttcactaagaaaatcgtttccccttcatatttaaagctcccgtattcagcttcaaaatcatgcttgtttaaggtcacattaaaccgttcgcataattgatcaatcaccataaaaccaatgttgtgttttgtctttgcatacttactgcctgggtttcccaagccaacaatcattttcattattaacgtcctctttttgactggcgctatcacgcaagaattctgagcagttaattctccccagtcgccagttgatattaagaaccattataccatattcagtttatttctctctttgtgaaagaaatagttttctgaaaatttaaccaaaaatcgcgaactttggtgtaaattatgctatactggttttcgaaatgaagaattgatttacagaaaggacgtcattatattggcaaacattgaaaaagatcaccaaaaagttatcctcgtcggcgacggcgctgtaggttctagttacgcttatgcattaactttacaaggtattgcacaagaagttggtatcgtagatatctttaaagaaaaaacacaaggtgatgcaatcgatttatctgatgcattagctttcacttctcctaagaaaatctatgctgctgaatactcagatgcaaaagatgctgacgttgttgttatcacagctggcgcaccacaaaaaccaggtgaaacacgtttagacttagtaagtaaaaaccttaaaatcttgaagacaatcgttgacccaatcgttgaatctggctttaacggtatcttcttagttgctgctaacccagttgatatcttgacatacgctacatggaaattatcaggtttccctaaagaacgcgttatcggttcaggtacatcacttgactcagctcgtttccgtaaagacatcgctgaaatggttaacgttgacgcacgttcggtccatgcttatatcatgggtgaacatggtgatacagaattccctgtatggtcacacgctaacatcggtggtatcaagatttctgaatgggttaaagctcatccagaagttaaagaagaagaacttgttaagatcttcgaaagtgttcgcgacgctgcttacacaatcattaacttaaaaggtgctacattctacggtatcggtactgcattagctcgtattactaaggctatcttagatgacgaaaatgctgtcttaccattatctgtatacatggaaggccaatacggcttgaatgatatctttatcggttcacctgctgttattaaccgttcaggtatcacaagcatccttgaaattccattgacagaccacgaaatggaaagcatgcacagttctgcaaaacaattaaaagatatcgttacaaaagcatttgctgaattagatatcgaaactcgccaataagctctttgcggttggtcaaacgactctcatttaatgggagtcgtttttttatggtgttaatattatcaactcgtttatactatataccacatcataaaacaaagatacgctagatttaatcgtcataatttagtggcgatagtgatggaagtggtgcaattgaaaatggctattaaaatcatcaaatttagtcaaagtgccctagtagcgccctaacgtgccatttttatgcaaaaaaaataggctaatcccctgcgggactagcctatttgagtaagcttattaaacatgctttttaaagctgactcctgcgcttagctacaatccgcaaacaatcgactaacgtcgattattcacgaatttaggctaatgctcagaatcaacccgctttaaacacactctttaataattagtttaatttcttcttgcttacaacattcaagttttcgtctaaatcataaacaactggttcgcctgttgccatttcaacgtccatgatgtcttcatcagagatgttttcaatgtattttgttaaggcgcgtagtgagttaccgtgagcggctacaatgatgttttggccgtcgattaattttggagcaatttcgtcttcccagaatgggataacacgttccaaagtaaccttcaagttttcgccaccaggaattgcttttggatctaagtgtgcgtaacgacggtcgtttgctgctgaaccttcatcacttgcatccaatagtggaggaagtgtgtcgtatgaacgacgccagatgtgaacttgttcgtcgccccatttttcagctgcttcagctttgttttggccttgtaatgcaccataatgacgttcgtttaagcgccatgatttcatttctggaacccataattgatctgaaccttcaagtgcatagtgtaatgtcttgatggcacgagtcaatactgatgtgtaagcttggtcaaaaaggatgccttcttttttcaataaagcaccagcgttttgagcttggcgtacgccttcttcgcttaagttaacatcaacccaaccagtgaattggtttgataagttccattcactttgtccgtgacgaataaaaactaatttagccatgtgtaagtaacctcactttttttatttttactctgttcattttacactgtttgctacacaatttacagtcttatcttttcagaaaataatgaaccttctttttttatgctcgatcagtcgttttcgtttctttcaataagaaaagcgccgccaagatggcaatcaccatgagcactagcgacgtcgttacaacagcgatcatccctttatcaaaagccgtgacaacaatttgttggacctttgcggcatacggtgtcttcactaattgttgcccccacgcgattgcatgtcctgaaaaagcacctgcttcaaccaatgcttgctgaatgccagttgctgccgccttcgggattgagctaccactaaagccagtcttcaaactcgtttcgtaggcattcgtttgtgataaaccgagaatcacaacaccgacggtaattccaatttggcggaaaacattcaataaaccggatgccattccgatttcttgaggattaatattatccatcgccgctgtattgatcattggattgataatcgcattgcctaacccagttagcgcaagcaatggtaagagttgcatataagtaaaatcagtcgttgtcacttgtctaaaaattaataaaccaagggcagaaacagtaaatccaaaagcaatcaaccattttttaccgaatttatagcctagaacacccgtgaattgtcctaaaacaagggaccataaactcattggcagttgatgcacaccggttgaaaaggctgagtaacccatgtaattttgcatcaaactcgtttgataagcggctaaggcaaaaatgccagcgcctaatgagaaagctaaaatcacaacacccacgaaatggcgattcgtaagtaacgtcaagttcatcattggtgcttttgctttcaattccacaaagacgaaaagcgctaaaattaaaacggaagcgactaaccaccccataatgcgcatatctgtccaagcccagtgcatatgttgttctttttgaatcaacccataaatcccggagaataaactaattgctgacaagatcatccccataaaatcgattgattcgcccgcgccataagctggtgtttctttaacattgcgaatcactaagtaaactgaaataatcccgactggtaaattgacgaaaaagatggatggccagccgaagttttcgactaaaaagccccctactaagggtccaatagcagttgaaaaaccaatcacggagcctaaaatccccagtgcagtcccccgttcgcgcccttcaaagttcgatgccactagtgccatcgataaactcatcatacccgagccaccaatcgcttggaccgcgcgaccaatatctaataccaataaatttggtgccagcccgttaacgacagaggccgctgtgaataaaatcatactcatgacaaaaattgttttgcgcccgaacatgtcccctaatttggaaacagtcaacaagctgaccgcatacatcaatgtataggcgttcaaaacccattgtaagttgctaaaagttgttttaaaatcaatcgccatacttggtaaagcgacattgacgacagttacgtctagcaatcccataaagacacccagactcatcgcgaccagcgctatccagcggttggttgtttttttcattttactatctccattttctctatctcatttatttgtgcttgtagccaatccattttggctttgatcgttgtgattacgaaatcggttgaacgaatctgccaataataataatccgtcattgtctcatccgcatcttttaattcagttagatgtttttccacaccgctataaacatgtaaatcttcagccaactcactgtagaaatcttgtaaaatgctgacttgttctgctgcatcaatgtagtgcatcccccgcatcttaaaacgataagcatcatcccacttcgcatcatgaacgactggtttagccattaattcagcaaaatagcgccgtccctcttcagtaatgtgcgcaatcttcgtaccacgtgaatcctgatcagcttcctcaaacccaatgcagcctttgctttccaatttatctaacaacggatacaaaaccccatttgaaattttccgtctgggtaccatcgcattttccaagataatccgcaacttatagcccgacatattccggctcattaaggcggataacatcagcaattcatacataaacgcataacctctctctttaatcagtcttttagacaggtctttaagacttattaagtgtagttctttccgacatatttacaagccttttttcatttttagacaaattaaaaaagcatgatccgcataagttgcctgataacaaggcttcatgcggatcacgcttttatggatttaggggtgtacattgagatgtcattataaatgaacatctttttcataaggaattgaattttgcgcgccttgggtttgaacagtaattgaagaagctttattagcaaaagtcatcgcttctttcaaattactataatccaaagataatttcgtacttaatgcaccgataaaggtatcaccagcagctgttgtatcaaccgcctgaactttaaaagcagggataaaaccgtccttatccgcagttgcataaaatgaacctttgtcaccaaccgtaataataactactttaatccccagcttaaacattgcttctgcatttgctttcatcgatgcctcatcagtaactttaatgctcgtaataatctctgcttctgtttcattgggaataatcatatccgtcacagctaacagctcagtaggaatatccttaattgctggcgctggattaagaattgtctgaacaccattttctctagcgattttaaaagcttcaatgatgacagggattggtacctcaaattgtgcaacaatacgatcagccgttttaattgcatctttagctgactgaatatcttccaccgtaatcgcttgattagctcccccataaatcaaaatactattttgaccatgttcatcaaccataatataagcttgtccagttccagctgtttcagaataagtcacatgctcgatattcataccatcttttttaaacgtatcaagcatgaaatccgctgcaccttcacgacctacttttccaatgaaattcgtttttgcacccattcgtactgccgcaatagcttgattagctcctttaccaccgccagcagatgattgcccacccattgctaaagtttctccaggtaacggtaaccgtggtatttgtaatattctatcaacattaatcgatcctaatactgtgacttttaccaaaacaattcctccttagtcccattataatcgtttcattataacgcatacaacatgctattgcatcgggattttaaaatttcaatccaatagaaaagcatcaaacggacagcgccgtttaatgcttttcaacgacttgcttatttctttaacgaatccgttgttactaattctaaaggtgaatcaatcttcgcttttacttttttaccattgaagtgatcatatgctgctttaacagctaatcgacccatttcttcgggttgttgtgctacagttgctgccatttcaccatttttgacagcttttagcccatcagcttcaccgtcaaaaccaacaatcattaaatccttattagcactcttagcagcttgcgcagcacctaatgccatttcatcgttttgtgagaataaccctttaatttcaggatttccttgtaaaatattttctgtaactgttaaacctttagcgcgatcgaaactagcagtttgttttgcggtaatatctaatttacctttaactgcattttcaaatcctttaccacgttcacgcgttgcagatgcgcctggcacaccctgtaattcagcaatcttcgcaccattacctaatttttctaacatatatttagcggccatttgcccaccctttgtactgttagaagatactaaagttaacactttaccactgtcactgctacgatcaactgtgataacgggaatcccagcgtcgttagcatctttaactgatgacgagatagctgatgaatcaactgggttaataatcaacacatccactttcttttgaatcatgtcttcaatatcatttgattgtttagcggcatcattttgagcatcaaaaatttgaacattactcttctttttagcagcatcgttaattccttttttaactgaaacaaagaatggattattcaaagttgaaattgatgccccaattttaactttatcagcagcttttttcgttgttttttcactaccgccatcattaccacctaagctagcaccgccacaaccagccaatgttgcacttaataatgtaacagccataacgccaactaataccttaaacttcttttgcatgataaaacctccagttaattatttttttgattctcgacgatcaagtaatacggcaacgatgatgacaatccctttgacgatttgttgatagaaactagaaatccccaatagattcatcccattattcaaagtaccaatgattaaggccccgattaatgttccaaagattcttcccttaccaccagcaagacttgttccacctaaaacaacggcggcaatagcatccatttcataagatgtccctgcatctggttgtgcagagctcaatctagaagttaaaataacgccggcaactgatgccattaatcctgaaagtgtataaataatcattgttacttttttagtattcacaccagcaacgtatgcggcttcttcgttcccgcctaatgcgtacgttttccgaccaaatgttgtcttgtgtaacacaacgtataagattccaaaagcgattaacatgataataattgggaatggaatgccaaatagatagccacgacccataaactgaaagaggaaactttcattaatttttgtcccagtaattggattcccgttagtaaatacataggtgccaccacggaaaatcgtcattgttgctaatgtcgcaataaatggtgctgctttcccataagctaccagaatcccattaattaacccaaacaacgctccagttagcataccgatagcaatcgaaatagctggtgatacacctgcctgaatcatataggccgaaatagcgccactcaaagctaaaattgaaccaacagataaatcaatcccaccagttaaaataacaaacgtcattccaaaggcgattaacgcattaatcgaaacttgtcgtaataagttcagtaaattagatggtgctaaaaagctcatattcataacacttactgctacaaccaatactagtaacgctaacaccggccctagttttgcgatgaacttctgggctgaaaacttttcacctttttttgctacatcattcattaacttgtcctcctgttgctaaagtcattacagattcttgagtcgccgtttttgtaggaataattcctgtaatatgaccttcatatacaactgcaattcgatcactcattccaagcacttcatccaaatcacttgaaaccataatgatggccacaccacgattcgttaattcattcattaagtcatagatttcccgccgggcaccaacatcaactccccgagtcggttcatctagtattaggacttgagtaccactaccaatccatttagctaaaacaactttttgctgattcccaccagataaactacctgccgattcagatggtccagttgccttgacatgtaaccgcttcattaaaagtgcgacaaaatctgccacggctttgtcatccaccaacccatgtttcacgaaaccgccaatacttggtaatgcaatgttatctgcaatactatcgtttagaatcagtccttcatctttacgattctccgttaaaaagccaatattatttttaattgcctctcccggagtcttattactgatggtcgttccattcatttgaatctgaccactgtctaacttatcgataccaaaaatggcacgcataatttcggttcgcccagcacccatcaatccagagaacgctaaaatttcaccagcatgaacttcaaaattaatatggtcaaaaacaccttttcgttcaatatcagttacttttaatgcaatatcacctggttgcgtacttctttccggataaaaatctctcatttcacgcccaaccatgtcccgtacaatctgtgccatattcgtttcgccagttggataactattaactgaaatcccatcacgcattaccgtaatgtggtcacaaattttcataatttcttccatgcgatgagaaatataaataatacctactcctcgctcttttaaactccgaataacatcaaataacttttcaatctccttttcggtcaaagctgcagttggttcatccataatcaatactttagcatcagacattagtgactttgcaatttcaatcatttgttgacgcccaacacttaacgatccgaccggtacatctaaatcaatatcagtccctaacttggcaagattctccttcgcaatcttgcgcatctcggcttgcttaagaattcccaagggacctttaatctcacggtttaaaaacatattgtctaaaactgtaatttcagcgaaattattcatctcttgatgaataaaactgataccgtgcttctcagcgtcaagggggttttcatagtaagtctcttcgccatcaattaaaatctgtccagcatcacgcttatacaagcccgttaagatattcatcaatgtcgatttacctgcgccattttcgcccattaaagcatgcacctgtccagctttaacggtcacatcgaccccttcaagaacgcggttttttccgaaagcttttttaatgcctttcatttgaacttccatcttttccacccctccttcaatattaaatagctagaacgttacaccacttaccaaaatgatattagcatatggtgtcatttcacccgtcctaacaaaagctttagcgtttgataaatccgctttcattttatcgtgtggtataaatttaatcggtacgtcaattatttctttaatagccgctaattgttgaggattttctgtcttgatttcttcagccaaataaacctcttgaagttgcaactcacttagaatattttttacaacatcaacaaaactaggtagtccatttgtaacagctagatcaattttttcagttcccactggtactggcatacctgcatcgccaacacctaatgtatcgtaatgccccatttgtgcgattactcttgataaattcgaattaataactgttgttttcttcattgctctacctcctgataatcaatgacgctcgcgcgctcaatcaatttagtcgccattttaattgtttgcggttttgcatcgggtgtttttaaacggtccaacaatagacctgttgcgactcgtcccaattcaataattggttgttcaattgtggttaactgcggctgaacatactgacaccattcaatattatcgtaaccaattatggagatatcttctggcacccgtttgccacgttcttgcaagccacggtacaaaccaattgccatttcatcgttaattgcaaaaacagcactgacccgactctcaattacctctgcagctgcttcgtagccaccttttttagttaattcatgttcgattagccaatctgaatcaaccgtaattcccgcattaatcattgccttttgatagccttttaatcgtttgtcaatattatttgaatgttgccgcggtagaatcaccgctacttttcgatgatgatgatccaataaatattgcgttgccttttgaccaccctcaaaatcacctgcaattattcgatcgccgctatctgaagcagattgatccattaatagatacggcactttatcttggtccaaatactgatgaataatatctaatccaacattgggcgccgcaattataaagccatcaacggttcggcgtacaagttcttgcaaataatttgtactccgcgtatcctgcgtcccaacattataaatcaatggaataaagccagcgcgtgatgctacttcttccactccttggctaaattgactaaagaacggattcgtaatatcaggtactaatacacctaaggttttagttgccttggtagtcatcccttgtgcaaaatagtcaggtacatatccaagtgatgcttgcgcagtacggacacgattgatagtttctttgctaaaacgatcacctttatgatttaaaatcaaagaaaccgttgttacagaaacttccgccaatcttgcaacatccttgattgttgccctttttggcatatcatcaccttcaattgagaatttagtaaaccggtttacttaacagaaacaatactaccatcaaaatgtatgcgctgtcaatattgctataacagcattttctcattcaataactattgactactaaaaaaaatagactaaacattgatttagtctacctttgcttaattaaaaaaaacactatctttttttaatttattttttctttgcttgtccgtatcctcgtttagatttataacctgcatctaaaatttgacacatttcaacataatgtcgttgctgtgtttcttcagctttagcgccgtaaacataacgtgcccattcgcgttgatagcctggtgttagtgcgtcgaaaaaggtttttgtggctggtgtatcttctaatcgagcactcaatcgggcaatctcaacttcatattctgataatggtttttgtggcatggtgcataactcccttattttaaccgcataacatctctggcaatcatcaactcttcattagttggcacaatcaggaccctaacgcgtgattgatcactgctgataatgcgttcttggctgcggacattatttttatcttcatccaattctacaccaaaacaagcgagtcgttcacaaatggcagcccgtaattcactgccgttctcaccactaccggcagtaaagaccagcgtatctactccattcattaaagctacgtaagaaccgacatacttcacaactcgattgacaaaaatatcaagcgccaattgggattgtggtcgtgagtcagcggtttcttctaaatcacgcatatccggtgatagttcagaaatccctaataagccagacttatggttcaaaattgtgatcatctctggcattgtcttacctaatttttcagctaaaaaggctactaatgagacatcaatatcaccagatcgcgtgcccatcgtaatccccgcaagtggtgtgaaccccattgatgtatcgacagcgtgcccgtcttgaatcgcggtaattgatgcaccactgcccaagtgcaacgtgatcattttttgcgtttcaagcggctgatctagcatttcagccgctcgatgagcaacaaaccgatgactggtcccatgcgcaccgtatttacgggccccatacttttcataatacgcttgcggaatactgtataaatagttttcggcaggtaacgtactgtaaaatgacgtgtcaaaaacagccacttccggtacgcctggcaataatgcagtgaaaattttaatgtaataagcttgggttggattatgcaacggtgcatattcagccaaacgattaatctcatcgagcccaaccggattaattactgcagagtccttgaaggcttctccaccagcaaccacccggtgaccaacccccgtaatctcatcgagatgggttacgatatttaattccttcaaccgcgttaataataacgttgctgcttgttcgtgcgtcgtaatatcttggacttgtttaaacttttcctgattgccatacttcactgtgaatacagaatcagataagcctaaccgatcaatcattcctttagcgattactcgttcagacggcatttcaaataattgccacttcagtgttgaactacctgcattaatagccagaattttttccatgatatcgactcccactctttcataatccgttcatggcttaattgtaagcaatttcataaaaagaaacaagccctattatatcagagtgcgtcatcaacgggtaacttctgagcatttatctaacttagcgaattggcgatgcaatcgccgatttgataagtgtagcaaagcacaggaagttattgatgaaagcacgtttaaggcaagaatgcatttggttgcggtcagcaactgagcattaatacaaactagcgcttaatctcgattttaagattaagtgctagtttagattaagcggaagttgttgcaaccaaaaagcacgttttatccataaaaaaagaaccgcccccacgcggttcttcctattttataataactattctgcactttcttcagacatgaatgttttctaaggtgtagtaaacatcattctatggaaaatcaatatttttaaaagcagagagaaccttcaaatatcactaaatagaactaaaaatcaaaagaatggcattcaaattggcattcaaaattggggcacataggaaagtaatatagagcaattttagttccaacacttctaaagtgacttcatttacctgaagtgttcaaagaattaggcattaataataatttcaagacgtaaaccacatgtaggtaacattttcgtgaagatctaagtgtcagtcaatatgcagatgtctgggcttttcagatatacgtattaattaattgttttaatcttttcgaaaaaataccatttttcagaataaattgaggacaagacattaatctcatcctctaccgattaaattgtattttgattcttaataccgctgattcgaattagtaactcaaagactgaagatcagctaatgtagtgtttaatccatactggaatttgatggtcgactctaataaatgttggagtatattgaagcccaactttgtcattaaagaatgatagtatcaattgtttgtcttcacttgataacgtatcaccatacttttttctaaattgacataatagattggcaatttactggtctctttgaattcaggcaacatttttgaaaactctcggcagtacgggcatcctttataaccaaccaacattaaatatgaatcaccacttttcagtagattgattagttctgaatcatttacttccttaatctttacagatttttataggccttcaattttatttttagtctactttaattatagatgaattttcatagagttattcttttgaacctgttgattttgaattacataaaataaaaatatttactaatataacaaagcctaaaaatagaaatttcgataacactttttcgccattccatattttagaaaaaatgacaaacattactatgttagttattgaaatgaaccagtcttgaacttttatttcaaagattttcttaggcacctgtccatgcaccgaaaccagctcctagcaaagcaccacctaccccacaaacagccattgcatatggtccaccagccgaacatatttttacacctgctgttgctccagataaagtagtacctaaaattcctactgcactacctccactaattgcttttaattcctgatcagaaagagaaactgtgtatgctttttcattcataatcaaaacactcctttatttttttgcatcccaaccagcggcagcaccacctgctacagcaccatacagtccaccaacaacaccacaagcaggtccacaaattgcagttcctaatcctgcgcctccagcagctcctgtagctaacccaccaacaacttgtcctaatttactccaagcactacctccaaatacttttttggcatcttcaactgacataccgttacttttcccattcaaaaaacctccaatttattattttcacaagaaaattctagcatagtgagcattacaaaaaataaatttatcatgaaatatctaaaatcaatcttgaaaaatacaagaatgatagtagtatcaagtgattaaactcacaactcacagatcaaatcatgaatgatatctacgaagcagtagacaccattctatggaatttcaagatttttgaaagcaaagagaaccttcaaatatcactaaatagaactaaaaatcaaaagaatggcattcaaaattggggcacataggaaagtaatatagagtaatttttgttccaacatttccaaagtaacttcatttacctgaagtgttcaaagaattaggcattaataatgatttcaagatttaaactacatgtagtgaacattttcgtgaagatccaagtatcagtcaatatgcagatgtctgggcttttcagatatacgtattaattaattgctttaatcttttcgaaaaagcaccatttttcagaataaattgaggacgagatattaatctcatcctctaccgattaaattgtattttgattcttaatagtgctgattcgaattagtaattcaaagactgaagatcaactaatgtagtgtttgatccaacaaacccatttactggaatctgatggtcgattctaataaatgttggagtatattgaagtccaactttttcattaaagaatgatagcatcaattgtttgtcttcacttgataacgtatcaccgtaagctttttctaaattgacataatagattgtcaatttactagtctctttgaattcagataacacttttgaaaactctcgacagtacgggcatcctttataaccaatcaacattaaatatgaatcatcacttttcagtagattgattagttctgaatcatttacttccttaataccagatatgttttgtagatattcttcttctgttacatttgtcgcattttgatggtcaacctcagtggaatttgtgccaggactattctcatccgcataggaattttgcggagcaaatgacagcccaattgtaattgaaaataataatactattaggggtaaaaattttttcttcattcttctctctccacttctatttaaaaaagtcctttattgcatttaatacatcctgggcgacatgaggaccgccagaaatgatatcaaatcctccaggagttcctcctttgatttttttcaattcttcttttggtaatgtttttcgatttgtcatctgaaccactctccttctatttgatgacattagtatattgttatctttgactatttagtgacttatatccggaaatcaacaatttatgtcttgaaatgaatccctattttgagttcaaaaaggtgctatttttatgattttttctcaaaagatgattccgcaatagaaaaaactcaagagcgcaggttcttgagttttttctatctattacattttaatgttaaatcacaattagttattcaaattgagaatatctaaagacacaaatagatattggataatgtattctaattaagggacttggaatttaaactcatgataaaaaatacaagaataaatttcaagccgccactaaattgttgcggcatcatttagctaaatttgatgagtattcctgtctattgttctttcaatcgttatatcatagtacctatttacgaattgagctttcagtgctatctaaggtttttcttaagattttgttttttgccaatgggaacctacaagaatactcttctggaaagaatatcattctactcttataatctacagaaattactttatttggattgattaaaaacgacttatgcacacgaagtaattcaggatattctttttctaaatcattcatctttccataaaattcatacatcatgttttcgccgtataatataattttatgaggcgtaaccgacgtttctaagaaataaatcgaagtaatatccactctaaaattccttgcaccaatcataaaggatagatgacgttcattggttctattatctacaaatgttaacttgtggcgtccatctaatacattttctatttgtcctttttcactttgttcgtccttaacaatataatctaacggtgctatttgtcgtttcaacgtctccattgccaactcttgatgagaagtgataaagacgatttgagcgaactcgttatcagttctaatacgttgtgcgacatcaattccatctaaatgttttccaagatcgatatccaaaaagtataaactatttgttaccttgttttttgataaatacaagaaaatatctcccggatcagtcgttgctaaaaccaattgcatatcataatcattgatcatgacccaattatcgataattgccttgtaatgagacatcaatattatgtcatcttcgcagagaataattggtaatgtcatattattcactctttcttatagttagtgtagaaacaaacattccttgatttgaataatgtgccagatcagcttgcttagttgcagtaaggatatcctgtgcattggataagcctagtcccctgttctttccctttttgctaaaccctacttttttcatctctgataaagaaggcagcttaccaaggaaagaattttcaattgaaatctcaatcgaatcggtggaatcaatgaacaatgtgtttattcttttttcttctgattcaattgctgcttccaccgcattgtcgattaatatacctaagattcggacaagtttgatttcatccatgttgatgtttgctattggaataagacattcaaaatttacctcaatgccagattgttctgcatggattaactttgctaccatcaaggattttacggagtctacttttaagttgcttagtcctgaaaaacgcatcacactgttatctatcatctgatgagaataatcgatcatcttatttaaatacccttcatcgatcgcagattcattttgcattgccttgagacctagtagcatatttttatagtcatggcggaatttacgcagttcctgatagtttctctcaatgtccgcagtatagactcgcatcatttccatctgttctttaaggttgctcaattcagttttttcgtgattctttttcaaagtaagataagtaaaatacatcgtaaccgagaattgagtaactaaaaaactgatcattacgatttgaaaaatgcctagtatttgcatccttcttaatacttctccaaacaaatagacaaacgtcaaaaatactcctagttgcatacaatacactttttcttcttcggaaggaattgtacgtttcattacctttgattttattgtcaacgtaatgatgattgacagaatccaatcaaatccaatcaaaataactactaacaaaggtcctcgttcattcaatacgtttaattcgagtttaaagattctagatataatgatagatgaaaagagtggtactatgctataaatcgttaaggaaagcaaaagacccaataactcggtaaatttgacttctggttcctttcgccaagacttaaatcttagtattacaattaaagagatcagtgcgattccagtcaaaagcgcatctgttactgaaagtaatgtgagtggaaaaaggaatataagtagagcaaaatagaatgatttttttcgaatatttgttagtagcccaatcatgaatagaaacagcaacagatcaaataattctttaaaaaaatacgagaaagaatctacaaaaaccatataaacacttccctattattatagatatctaattataacaagaatcaataaaaataggcagataatgaaaattcattatgattggtcttttaattttggaaattaacgtttcttagttgctttcttacgtgctttagcaagtgctttttcacgatcacgcttttctttttccttggcttcgcgttcgcggcgaatcttaaatggattttgaatcaccattgtttgacccactgaaaaggcgttcgttaccacccagtaaattgaaacagcagacgcgatgttcatggccatcacaaaaatcatgattggcatcacccacaacattgcggatgacgcagcattcttcgtgggttgcgacatcattgttagatacgatgttgcaaatgtaaagatcgcagccaagatagccataataaagtaaggatcagctttcccaagttgcatccataagaacgtcccactctttaaagcagctgttcgatagattgcttggtacaaggcaatcaacactggcatttgaaccactagtggtaaacagcccacaactggattgacgcccgcttcagcatatagcttttgcgtttcttcgcgtaacttctgttgtgtctcagcatctttagaagcatatttcttttgaagtgcttgaatttctggtgcaacttcttgttgtttgagcatgctcttactttgccaccaagttaatggcaagataatcacccgaatgatgatggtgaaggccacaattgcccaaccataactgccaccaaagatgtctgctaaccataaaataaagcgggaaaagttataaataacataatgatcccagaagccagtactgctactatcaactggtgatgtactacaccccgctgcgattagcatgaacaagaatagactggccactaataatagccgtttgcgattttttgaactcactgtaatccctcacttattcagaagcagaatctgcttcttcctttaatagctttgctagttttaagacgtgcattaaattctgtttggtttccgccattgttagttggttagcgccacgtcttgcgatcactaaaaagtcgacagtctgtggtaactctggcttcaactccaacaagctctggcgaatgtaacgtttaacctgattacgcatcactgcgttacccacttttttacctacggacaggcccacccgaaaatgcttttgaccaggtttttctaattgataaaccacaaaattgcggttggcaactgaatgacctgcttcaaaaaccgtttggaaatcctgttcttttttgacgcggtacgactttctcataattcactccggcatttcatttaattaattgaggataataaaaaaaccactgaagcatcagtggcctatgcagataatacttttctgcctttagcacggcgtcttgcaagtaccttgcgaccgttcttagtattcatacgtttcatgaaaccatgaacacgttctttatggcgtttctttggttggaaagttctctttgtagtcattatactggcacctcctaattgactgtgtctattgttttcatatctgagaaacaacgggtgataaataccacctacgacattcactaaaatataatagcatatttctatagaagttaaaacactttccataaaaaaacagaataaatattcttatccacaaaaaataattcattggctttcttgtggataactgattataccgaatcgtccgatttttgtcacgcacagattacttgctgatttatccagaaaatcacagggtgttactatgttatccacaagctattttcaagctgtgcataaattgataaaaccttttaatagcaagcatcagatacacacacttttttgtggataagtgcgataatcgtttgttgttttttgttttccacagtccccactaaaagttatccccggtcgtgtgttcaagtggataactttttaattcattcctgtggattttgttcttgttgtggaaaacttttttttagaatgctagaatgtagatagtctttctttattgaactttttttcaataaagtggttattttacgtgaggaggacacgctacatgcctgatcttcaggaactttggaactatttgcgggaagaattccaaaatgatttaacacccgtcggttttaatgcttggattaaaaccgccaaaccgcttgcttttagagccaatgaaatactgatcgaagtgccttctcctttacacaaagagtattgggaaagtaacttggccactaaggtcgttgaaggggcctacgaattcgcagagattgaattgacccctatttttctgttacctaccgaagccgagcagcttcaagctgaaaaaccagctgaagaacgcagcctcaccaaagctgaaaccccaacctttttacgtgaaacgcatttaaatagtaaatacacgttcgacacgtttgtgactgggaaaggcaatcagatggcccacgctgcagcactcgttgtttcagaagaacccggtgttttatataatccactttttttatacggtggcgttggtttaggtaaaacccatttgatgcaagctatcggtcaccagctgttactctctaaacctgacacgaacgtcaagtatgtgacgagtgaagcttttgccaacgacttcatcaattcgattcaaacgaagaatcaagaaaaattccgccaagaataccgaaacgttgatttattattggtcgatgatattcaattttttgcggataaagaagggactcaggaagaatttttccacaccttcaatgatctctacaatgataaaaagcaaattgtcttaacatctgatcgtttacctaatgaaattcctaagctccaagaacgcttagtttcacggtttaaatggggcttgtccgtcgacattacaccgcctgatttagaaacgcgaattgctattttacggaacaaagccgacacagaacgcctcgaaatcccagaagatactttgagctacatcgctggtcaaattgattccaatgtccgtgaacttgaaggttcactggttcgggtccaagcttatgcaaccatgcaaaatgctgaaattacaactagtcttgccgccgatgcccttaaaggcttgaaactcaatgggaagtcgagtcaactttcaattgctaagattcaatccgtagtcgctaagtactacagcctttcaatcactgatttaaaagggcgcaagcgcgttaaagaaattgtgctcccacggcaaatcgctatgtacttggcccgcgaaatgaccgacagttctcttcccaaaattggacaagaatttggcggtaaagatcatacgaccgttatgcacgcacatgaacgaattagccaagcgttaacgagtgatcaaaatctaaaagatgccatcttagatttgaagaataccttgaaaggctaaatataggctgtggataaacgctaaagttatcctaagagttgttctcaatttatccacaagtggaaaactagacactcttttgcttttctatgttatccacaggttccacaggccctactactattacttaaaattcttttataatatatatatatctattttccttcggaggtttaacatccatgaaattctcaattaaccgcaacgtattcatcaaaaccctgaatgatgttcaacgtgccatttcagctaaaacaacgattcctattttgacggggcttaaattagtgctttcgcaagaaggcttaaccttaaccggtagtgatgctgatatttcaattgaagcaacccttgctagtaatgatgaaaagaatcaattagtcgttgaagaagcaggtgccattgttttaccagcccgcttctttagtgaaatcgttaaaaaattacctgaagatcaaatgacgattgctgttggtgacaacttccaaacaacaattcgttcaggtaaatcagaatttacaattaatggcttagatgctaatagttatccacatctacctgaaattgcgggtcaaaatccattcagtatcagtactgatgtgcttaaacaattaattcatcaaaccgtcatcgccgtttctaaccaagaaagtcgcccaatcttaacgggggttcatttggttttaaaagatggcgaaatgttagccgtcgcaacggacagtcatcgacttgcacaacgaaaattaaccgtttcagtaccaagtgatgtgaactacgatgtcattattcctgggaagagtttaattgaactttcaagaacgttagcagacgacgttgaaaccgttgaaattcggattgctgaaaaccaagtgctctttaaagccggcaacttagccttttattctcggttgttagaaggaaattaccctgacacagcacgtttaattccaacttcttcaagtacacaaatcgaattcaatgcaccggtcttattagctgcgattgaacgggcatcattgttgtctcatgaaagtcggaacaatgttgtccggttgacattgaatacaacggacaacacggcaatcatctacgggaactcaccggacgttgggaatgttgaagaagcccttcaatttgaaaacctaacgggcgaagatctcgaaatttcatttaacccagattatatgaaggatgctttacgttcatttggtcaaacaaccatcgtgattaactttacggcagctttacggccatttacattggtcccaagtgaagatcaagaacactacattcaattaatcacaccagttcggacattttaataatcaaaaaacgccgcatttaaaaatggggcgttttttttgcgctaaaattaaaataaattcgtttacagcgatttcggataaaacaagtaggataaggttaaagcacttaaaaacgctcagaaagcattttagctatgtttatttgtttttaaggcaaaaaaagtctataattataaggtataacggatcggtattagcgcagtaattaatatcgttaagaatggtgggttgagtatggcacaagaaattaaacttaaagctgagttcgtgacactcgggcaactccttaaagaggccggtgtgattgaaacaggtgggcaagcaaaatggtttttaaaagaaacaacggttttagtgaacggagaacctgatgatcgtcgcggccggaagttatatccggaagacgtcgttgaggtgtccgataacggccagtttgtcattaaacaacaagaaagattgtaggcgactatgtatttaagtgaactccaacttgatcattatcggaattacgagcaagtggacgtccatttctcgccagatatcaatgtcttgattggtgaaaatgcgcagggcaaaacgaacttgctagaagccatctatgtgttggctttggctcgttcgcatcggacgaataatgatcgtgaactgatacaatgggatggcgaattcgcaaagattaccggcttggtacaacggcaaactggccacacaccattagaattggtggtcagtcaaaaaggtaaaaaagcgaaggtcaatcatttagaacaggctaagttatcccaatatatcggtcaattgaatgtcgtcttgtttgcaccggaggatttgaacatcgtgaaaggctcgccagctgtccgacgacgctttatcgatatggaattcggtcaaatgagtgcgaagtacctgtataacatttcgcaatacaagtcgattttgaaacagcggaatcagtatttgaagcaactacaacgacgtcaagctaaagatttagtgtatttaggcgtattgtccgaccagttagccgcttatggcgcggaagtcacggttgctcgccgtgaatttctgcaacagatggaaaagtgggcgcagaagttgcatcaagagattaccaaagagcgggaagttttgacctttaaataccaaagtcagattccagatgagcagttggcactcgatgccgaaggtttataccaacagtttcaaaccctatacgaatcgcaccaaacacgggaagtcgaacagggcacgacattggttggtccgcaccgcgacgacgtgttatttttggttaacggtaaggacgtgcaatcgtttggctctcaaggccaacagcgcacaaccgcgttaagtgttaaattggcggagattgacctaatgaaggaacaaaccggtgaatatcccgtcctattactggacgatgtgttgtccgagcttgacgatttacgccaaacacagttattgaagacgttccagaataaggtgcagacgttcttaacgacaaccagtcttgaaaatgtcaaaaaagaaattattagtgcgccacgggtgtttaccgtgacaaacggcaccgtgacagtggccgatgcagcagcaaattagtcaaaaaacgatcaaacggaggtttttttcttggcagatgatcaaatgaatcaagagacagaagcacaaatggaagcaaaagaagaacgcgctaaatcttatgatgccagtcaaattcaggtgttagaaggcctagaagccgttcgtaaacgaccagggatgtacattgggacaacgagttcgcaagggttgcatcatttggtttgggaaattattgataatgggattgatgaagcactcgctggttttgcaacagaaatcaacgtggttgttgaacccgataatagtattacggttacagatgaggggcgtgggattccagttgggattcaagctaagactggtaagtctgcgctcgaaaccgtctttacaatcttgcatgccggtggaaaattcggcggcggcggatacaaagtatctggtgggttgcatggtgttggggcttcggtcgttaatgccttgtcaacggaattagatgcggttgttactcaaggcggtaaacgctactacatcgatttcaagcgggggaaagtgcaaacgccaatgaagatgattggtgacgcaccagcccatgaacatggtacgaaagttcattttgtccctgatgctgatatctttactgaaacaacggtgtatgatgataaaattttaacaacgcggattcgggaattggccttcttaaacaaaggcttgaagttaacgttcaccgacaaacgggctgaaacacatgaaaaacttgaattccactatgaaggtgggattaagagttacgttgaatatttagacgacaaaaaagagacccttttagacgaaccaatctatgttgaaggtgaacaaaacgggattaccgtggaagttgctttgcaatatacgaatgattatcggacgaacttgatgacctttgccaataacattcatacctacgaaggtgggactcatgaatctggctttaagacggcgctcacgcgggttattaatgactacgcaaccaagcaaaacatcttaaaagccaacgacacgaacctttctggggaagatgtgcgtgaaggcttaacagcggttgtctcggttaaacatccggatcctcaatttgaaggtcaaacgaagacgaaattaggcaatgccgacgcacggacggtgactgatcggatgttctctgatcatttcacgaagttcttgatggaaaacccatcgattgcccgccaaattgtcgacaaaggctcattggctgccaaagcccggttagctgctaaacgcgctcgtgaagtgacacggaagaagaacggtcttgaaatctcaaacttgccaggtaagttggccgataatagtagtaaagatcctgctatttcagaattattcatcgtcgaaggggattccgctgggggttcagcaaaatcaggccgttcacgtttaacgcaagccatcttgccaattcgggggaaaatcctgaatgttgaaaaagctagcatggaaaaaattttggcgaatgatgaaatccggaccttatttacagcaatgggcactggttttggccaagaattcgatgtggctaaagcccgttatcataagttgatcatcatgaccgatgccgatgtcgatggtgcgcatattcggacgttgcttttaacgttgttctaccgttacatgcgaccaatcgtcgaagcgggttacgtgtatatcgcacaaccacctttgtaccgtgttaaacaagggaagatgatgcgctacattgattctgatgaggaattacaagaagtattagggacgctccaaccaagtcctaaacctgaagtgcaacgttacaaagggttaggggaaatggatgctagccaattatgggaaacaaccatggatcctgaaaaccggcgcatgttgcgggttaacgttgaagatgccgaagaagcggatcaaatttttgaaatgttaatgggtgatcgggttgaacctcgccggattttcatcgaagaaaatgccgtttacatggatccaaagagcatcgatgcatagcgtgttcgccgcttaaacggacacattgaaagactgactgagaggggtttatcgattaatggcaaacgaaattggccaagacggtcggattgaaaacgtcaatttatctaagacaatgcgtaaatcattcctggaatatgcaatgagtgtcattgttgcgcgtgccttaccagacgttcgtgatgggttaaaacctgtccaacgccggattttatacggaatgaatgaattaggggtcactcctgaaaaaccttataagaaatctgccagaatcgttggggatgttatggggaagtaccatccacatggggattcagcaatttatgaagcgatggtgcggatggcacaagattttagttatcgttacatgttagtggatggtcatggaaactttggctctgtcgatggtgatggcgctgccgcaatgcggtataccgaagcccggatgagcaagatggctgtcgaaatgttacgcgatatcaacaaaaataccatcgattatgtaccgaactacgatgaatcagaacgcgaacctgctgttttaccagcgcgttttccgaacttacttgttaatggtgcgactgggattgccgttgggatgaccaccaatattccaccgcataatttagctgaagtcatcagcgcactacacatcttgatggataatccagatgcgacaaccgctgacttgatggaggctttacctggccctgatttcccaactggtgggttagtgatgggtaaatccggcattcgtcatgcatatgaaaccggtaaagggacgattaccctccgcgctaaagtggatgttgaagttcaaaagaacggtaaagaacggattatcgtcactgaaattccatacatggttaataaggccaagttggtcgaacggattgctgaattagcccgtgacaaacggcttgaagggattaccgatttaaacgatgaatctgatcgtgatgggatgcgcatcgtgattgatgtgcgtcgggatatgagtgcttcagttgtcttgaataacttgtacaaattgacaccattacaaacctcattctcatttaacatggtggccatcgtcaacggcgcaccaaaagtcttgagtttgaaatcaatcttggaacactacttagtgcaccaagaagaagtcattcgtcggcggactgaatttgatttgaagaaggctgaagcacgggcccatattttagctgggttacggattgctttagaccatatcgatgcgattattcaaatcattcgtggttcgaatacaggtgatgccgctaaggtcttgttgatggatcgttatgatttatcagataaacaagcgcaagccatcttggatatgcgtttggttcgattaaccggtttggaacgtgataaagtcgaaaatgaatacaataatttgatgactttaattgctgatttgaaagatattttagctaaaccagaacgcattaagaagattatctacgatgaattgcttgaactccaaagtaaattcggtgacaaacgccggacagaattattggtgggtgaagtgcttagtcttgaggacgaagacttaatcgaagaagaagacgttgtgattgcattaacgcataacggctacatcaaacgattaccagccagcgaattcaaagttcaaaatcgtggtggtcgtgggattcaagggatgggcgtccatgatgacgacttcatcgaacacttgatttcaacatcgactcatgaagtgctcttattcttcaccaatactgggaaagtttaccgtgccaaagggtatgaaattccagaatacgggcggactgctaagggaattccaatcattaacttattaggcattaattctgatgaacgcgttcagaccgtggttaatgttggtaaagaagtgcaagacgaacaatcactcttcttcattacgcgcttagggacggttaaacggacatctgttgccgatttcgctaacatccgcagcaatgggttgaaagccttgaccttgcgggaagaggatgaattaagtaacgtcttgatgactgatgggcaacaaaatatctttatcgggacccataatggttatgctgtgtcatttagtgagacagctgtccgttcgatggggagaaccgctgctggtgtgcgtgggattcggttacgtgaaggcgactatgtggtcggctctgacttactgattccgggtcaagaaatccttgtcatctctgaaaaagggtacggcaaacggacaccggttgcagattatccaatcaagggtcgtggtggtaaagggattaagactgccaacatcactgaaaagaacggcccattagctgggattgctgccgtcactggagaagaggatattctcttaatcactgatactggcgtcttgattcgtttcaaggtcgctaacgtttcacaaactggccgggccacacttggtgtgcgtctaatccgggtggatgacgaagcgaaggttgcaacaatggcgaaagtcgaagctgaaccagatgaacctgaaacaccagaaggcaacgacagcaccaacagcaccaactgatgacactactgatactggcttagcacaagtcgatgaattactcgcgcgggctgaagccgatcaagcggcatcagatgaccaagactcagaaaattaattaaattaaaaaaataaaaatcgtttctgcgtaaatacacttgtaacaactgttaccaagcgtgttagcagcaacgatttttattttagattgtattttaacggccgttatgatagaattttatcttgtgagtatctgtgatttagacacagggtctaaatcgtgaggctaatttttattagtcagttactccttgttcttacacaggtaagaacctaaagtccataaggaggtgaacagtcatggctcaatcaaaatacgaagttacttacatcatctcaacaacacttgatgaagaaagtaaaacagctcttgtcaaccgttacgacggcatcttaaaagacaacggcgctgaagtgattgattcaaaagactggtcaaaacgtcgtttagcttatgaaatcaacaatcaacacgaaggcatttaccatatcgtaaatgttttagctgataatgatgatgctttaaacgaatttgatcgtctagctaagattgatggctcagtattacgccatatgatcgttaaacgcgaagactaattttgaattgtaattattgaatagaggggagctgacagaatgattaatcgagttgtactcgttggtcggctaacacgcgatgttgacttacgttacacttctagtggtgctgcagttgggactttctcaatcgcagtgaaccgtcaattcacgaatgccaatggtgatcgtgaagcagactttatcaactgtgtcatctggcgtaaatcagcggaaaatttcgctaatttcactaagaaaggctcactagtcggagttgatggccgtctacaaacgagaaattatgaaaaccaacaaggtcaacgtgtatacgtaaccgaagtggtcgttgataacttctcattgttagaatcacggacaacaacggagcaacggcaaggggatggcgcaagccaaaactttaacagcaatcaaagcaatggtagccaacaatctggatttaccagccctcaacaatcgggtaatccatcagctgcaaataacactcaagccgatccatttgcaaataatggtcaagcaattgatatttcagatgatgatttacctttctaaaataaactgttttggaaggaggaactttcaatggctcaacaaagaagaggcggcaaccgtcgtcgtcgtaaggttgatttcatcgctgctaaccacatcgaatatatcgactacaaagacactgatttattgaaacgttttatctcagaacgcggtaagattttacctcgtcgggtatctggtacaagtgctaaaaaccaacgtcgtttgacaattgcaatcaaacgcgcacggattatgggcttattaccattcgttacagaagactaatcagtcaaccaaaggacctgctaaacactgtttagcaggtctttttttgtgcgctttaataggggaacatgggattaaattacgggttcaaagcggtaattgtagggcaattgtgctaaaataaaagtagcattttttaagttttagtaaagaaccacatagactcaatgatagatgaacaagaatcagaatgggatctagaattaaggagtttacatgaaaaataagtttaaacaattaaaattaccacagtttttagatgatactcgcctgcggaccgttgccctgattttgttgggccttacagcggttagtttggtatttgctgcaatgttagattggctaattgctctaattttattcgtgctgctaatcgggacggtcattactgtgctatacgcgatcgaaacggtcactgagaatacagccaagtatgtctcggacttgtcgtaccgcattaagcgcggcgagcaagaggctttaattaagatgccaattgggattttattgtacaacgaatcaggtgagattcaatggacgaatccttatttacagcaatatttcggtaataaagaagttttaggcaaaaagattaagtctgtcgatccagagttggcagaattagtcgcacaaaatgaagatgctaacgaaacaaaaattgttcgttggggcgataatcaattccaaatcattatccaagaaagcattggggtggtttatcttctcgatattacacgctatgcggccattgaagatcgttatgaagatgagcaagtagccatcgggcaagtgttcttagataattatgatgaaatcactcagacaatggatgatcaatctgtttctaatctgaataactatgtcaccaacgagttatcacgctgggcgaatcagtttcagatgttcttgaagcgagttgatgatgatcatttctttgttttagcgtatgccaaatcattacacgccgctgaacaagagaagtttaagattttagatgaaattcgagaagaaacatccaaacaaaacttcccattaacgttgagtgttgggtttgcttatggggaatccgatttagccgtgctagcaacaacttcacagagcaatttggatcttgcccttggtcgtggtggtgaccaagtcgttgtcaaagcgagtgaaggacaagcacgtttttatggtggtaagactaatccgatggaaaaacggacgcgggttcgtgcacggatgatttcacaagccttacaagaaatcttcaaacaagtcgacgaagtctttgttatgggccatattcggccagatatggatgcattgggcgcctcatttgggattcgccggattgccgggatgaacggtaagaagtgctacgtggtcgttgaccaaaacaatattcatacagatattcaacgtcttttagaggaagttaaagcctaccctgaaattgcagtggaagtgttgtcgcctgaagaagcactcgaaaaagcaacggctaatagtttattagtgatggtcgatcattctaaaccatccataacaatggcgcctaagttgtacgagaagcttgctcagcggacgattgtcatcgatcaccatcgtcgtggggaagagttcccagaaaacccaatgttggtttatatcgagccctacgcctcttcaacgtgtgagttagtgacggaaatgtttgaatatcaaccacaaaatgtcgctaatatcagcaagttcgaagccacaacgatgttggctgggattacggttgatacgcagtcattttcaatgcgaactgggacgcgaacgtttgacgcagctagttatttacgttcagttggagctgatgcttcgatggttcaacacttgttaaaagaaaatgtcgataattatattcaaaagaatcatttaattgaaaccattgaaatggttgagccaaatatggcattatgtatgggtgaggacaaccgtacctacgatccggtcatcgcagcacaagcagcggataccttgctgtcattgtcaggcattgaagcctcgtttgtcattgtgaaacgcccagatagcatgattgccatttcagcgcggagtctaggtgatgtgaatgtgcaagtgattatggagaaattaggtggcggtggtcatctttccaatgcggcaacgcagatggcagatacgactgtttccgaagccaaggcgaagttattaacggttttggcagagctatttgacccggaaacggacgaggaagcaacaaacgattaattagataaggtggtcagaacaatgaaagttattttcttagaagatgtacgcggtaaaggtaaaaaaggccaagtgaaagatgtgccagatggttacgcacaaaattttttaattaaaaatgggaaagcaaaaccagcaacatcagctgctatcagtgctttaaaaggccaacaacatgctgaagctaaaaatgcagctgctgaattagcggaagcaaaggttttaaaagccaaaattgaagacgataaaacaatcgttgaaatcaaatctaaagcgggtgaagacagccgcttatttggttcaattccaagcaagcagattgcccaagcattggctcaacaatatcagatcaatgttgataaacggaaaattgatttaccagaaccaatcaaagcgttgggttaccggaatgttgatgtacggatccaccctgatgtaacagctacgattcgtgtgcatatcgtaactgaataataaaatgaatgattgaaaagaccgtgattagcaccactatcacggctttttttattgctgaccaatcggtgactgttgccagtcactggtattttgagtaaactagtgagtaattgaagtcgattaaccaaaggagtaaaaatggtgaataatgaactaattgaacaagtaccgccgcagaataatgaggcggaacaggccgttttaggggccgtctttattagtggcgatgcgctcgttgaagcaatggaatacgttactgccgacgatttttatcgtaaagcccaccgtttgatcttcgagacgatggttgaattaaacgaacggggtgaaggaatcgatgcggtgactttaaagagtgccctcgatgcgcagaaccaattggaagatatcggtggtattggttatttagctgagttggctgaggctgtaccaacggcagccaacgtggtttattatgcaaagattgtctctgaaaaagcaatgctacgccgtttaatccaaaccgctcaaaatattgtggcaaagggttacgcgcaagatgaagacgtcacggatattttagataccgctgaaaaggaaatcatggatgtttccgaacggcaaaataaggccggtttcaaatcaatttcagatgtcttaacgagttcaatcgaacaaattgataagttatatcaaaatgaagaagacattacgggtctatcaacgggataccgcgatttagataagattactgcgggtttgcatgaagatgaactcattattttagcggcccggcccggggtggggaaaaccgcgtttgtcttaaacattgctcagaatatcgggacgaaaaccaatgagaatattgcaatttttagtttggaaatgggtgctgaacaactcgttaaccggatgttgtgtgcagaaggaagtattgacgccaaccatctaagaaccgggcaactcgacgaacttgaatggcagaatctaatcgtagccatggggagcctttcaaaagcgaatatctatattgatgatacgcccggcgtgaaaatggcggaaattcgggcgaaatgtcggcgcttagcgaaggaaaaagggggcgttggcttaatcgtcattgattacttgcaactaattgaaggttccggccaagaaaaccggcaacaagaagtctcggcgatttcacgtcaattaaagaaattggctaaagaattacgggtaccggtcattgcgctctctcaactctctcgtggggttgaacaacgacaagataaacgcccagtcctttcagatattcgtgaatcaggatcaatcgaacaagatgctgatatcgttgctttcttatatcgtgatgattactatcgcgatgaacctggggaagatggcgatgatttcggtggtggcaatccgccagcaccagcgccacagcagtcagatgatgcggacgttggagaagttgaagtgattatcgaaaaaaaccgtgcgggtgcacgagggacagtcaaattattatttgtcaaaacgtttaataagttctcatcaatttcgtatgcggaccaatagtaatgactatttttaataaatagtgaatattatcgtaaatgaaatacttaaaaaaaccatcataatttaatacatttgaagattatgtatctgccaatggctatgctaaaacgtcaacatatgtcatgcgttattggcttacaattcaacgtgttttagatgcacaactacatgataagaatttatgggtagctgagtatggtacttctcagtgcggttatccatgtgaagcatggcaatttacaagtacatgggataataatggtaacaaaattgatatgagttacgattacaatggacggttcactgaagacgaagatgatggtttcaaaataactgaaaagcaatccgttaataagaatgttcaaattgcgagtcatgattacagcttatttaatacaccatcgcctttaaatggcgctaagttattaattaatggtcgcgatttaactcagagtgttgttcatgtagtagccaagtataaagtaagtaatggtgaatattattataactggcagattgcaagaaataacttgaacgaatttaatgacgtaaattaagcaagaagatctcgattggtgtatgccaattaagacatttaagtggccgtgaattcaaataccaattaatttgaaccaattggtgatcacttagttcttcaatggcttggcctttgggaataaagcgccgcaaaactcggttacggttctcattactgcctctttcatgcggtgaataggcatgggcaaaataaacctgtgtaccagttcgccgttcaattgtctgatagttagcgaactctttaccatgatctacggtaagcgtcttgagcttgtcttgaagttgactagctagttcaagtacggtttgagtcatggactgactgtcgcgaccatggagccgtttaacaattgtcaggcgactcttacgctccacaaaagtagccacagcttgacctttacgtttaccagaaagtacggtatcagcttcaaagtggccgaattcctggcgagtttcgactttatgaggccgctcctcaatggagcggccgtgattgaacgtaccacgcttttctttagcacgatgacgacgaattccatgatcaggcaaatcgggcaactgtatatcaagccatccttgatcaatccagttatagaccgtcttgtaggcaatccccaccacatgggcaacttgttcaggggaccacttctggacttgaatcttttcctcgatcaagtgtttaaggtttttagtgagcgaagacttccgcccccgttgactaacctttcgttcaaagtcagtttgcgctagcccagcctggtactcactatttagccggtgaagttcgttaaagatggtggtcttactaaagcctaagtagttagcgatgtatcgcaaggaacgtccttcattatgaagcgtttcaatgacaacacggttctggaatgataaaatagtggtgctcatcaaggtccttctttctaatggattgtgtggtaacaccattaaagaccttgatgggtttttctgtccacttaaatgttcaacttaaattttacaatctgccaactttaaatatggtgatcgttattattgggcaaatacacgtgcctttaccgacgtatttaaggtagttgataaagaatcaatgaataaagattttagaattagtttaaataactatggcttttataatacaccgtcaccacttccgggaacaaaattattattagcaggttcacaagttgatcatagagttgtccatgttgtggcaagatataaggtaagtaatggcgagtattattataattttaagtataatgatcgttattactggtgtaattcgaaagcttttgcagaagttgaaaaatctgttcaaaaggcaacgcttaaattagataaggaatcggaatcaagtagtgctgaaagtaaagaaacatcgtcacaagaaagcagtaatatgataaaagaagatagtgctaaagaagccacttctcaaagtagttcaacatctgaaataagttcagtaagtactagtcaagttcaaaaagaatcagaatcatcagaagcagtagttaatggtgaattacagtcgagtgctgtagtacattaatttgttattagatcagacaaagatacttgttagcgcaagtcagaacagaactatcatagttagattgatagttctgtttttttatacatatttaattttaacggtaattaacggcatataatttgtagaagttagataaatataatggtatgattaatttatcacaaacttgcaggtgtaaaaatgaatagaaaaaataattttaaatttgaaatcttatcaattttaataatattggtatgtgcaattatattagtaataccgcagattagaagtaatgctgttatttttggaacggacactgtatttcatatgaacagtttttatgagactgctagtcaaattcttaatggcaagtttagttattttcaatctaattttggttataatggttccgctagaattgtttcagcgctgtacgggccagctattaattatttaggtggtattattttagcgttaagtaagagttgggtgacgttgcaagtcgttttaaatataattgtattgtgggttgcaggaagtaatatgtacgctttaaatcgctatctaaatgttaaacgtttgattgcgatagttatcagtgtactatatatgttttcaccagttgttttgtattgggtaattggacataattttaccggctggggcgctgctttcttgccattgttatgtatttcagcagttcgtgttatccaggatgaagcgcagcctgttaatgttgtattattatcgattactatgtcaattctaattcaagtccacttagtaactagtttaattggcattttaattctagtattattctatagttttggtttgtacaaaagtcgagataaaaagaatttactaattaaggtggtaattgcggcggggataacgttgttattgacagcgaatgtttggggcgcaatattggatgtttatagtgggaatactgttgtttcaacttttcccaatccagatttaagtaattcagtaatgcattttacaactaccagttataactggaatcactacggactgatatttagctttatcttcatcgcacagacgatatatacattaataaaattccgatatatggcattggttgaaaagcttattaatggatgtggtattatctttttaatcggttcatccagcttaatgccgtggaagagagttggaaatcattttccaatcttgaaaacgatgttacagtttccagagagattatcagttattagttttgtacttttgctcttaggaatcggaatagcattaagtaaagtttcttatacaagactagttagttgcggtatgctagtgattgcgagcataatttttattaacgctagacatttagtacaggctcctattgcacattggcaggggagcgatattaatgccttatataatggtgaaagatcaacaaatgatattaaattattgaaaaaaagctttcaaaacaaaaataaattaaatgcagggttactattattacctaagagaacacctgattatttaccagctacaccaagtattaaaagtgctgagtatagtcaagtagatccatataacctgtataaacaacaagtgttagataatcaaattatagtcgaacgaaaggtgaataagaataaacagatagtaaaatggatcaatacggatcaagaaaaaaagaatatacaactaccaattattaaatacaatcacagtcaggttgttgtaaatggaaaattaataaaagatataaaaataactagaattggcgctatgattatcccttcaaaagcgggaattaatactttagaaattagttatcatccgaatggaataattcatatattgatgcttaatactattattgcctggctattgatggctgtcgtcgttattctttattggaataatttatttaaaagattaaaaagtatttaaaaacttttaactaggggtattcatctgaggatatccctttttatttaggccggaacaatatacactgatagtgtataatgaattattggattatatgcaaaatataaataatgaatggtatgggttaaaatgaaaaaaattattgctaataaagcattagtactgaatgttatcagtatgactatttttattgtgattatcagttttacatttagaagtaatccgatatcaactgttttaccaacacatgattcatccatgtttctttactttggtagagggattcataatggcatgataccttacgtcaatatgtatgatcataaaggtagtgttttgttttatgtgaattcattggcctacttatttggtcaagggtatgcgcaatttctgttgtggataattgaggttttatttttaactaccacagtgatattactttataaaatacttaattatttattgaaaaatagttatttagtttgtttaacaatttggctctcgctaggactctttattgagttatttgcaggtggtaatttttctgaagaatatgcgttaccatttatattagtagcactgtatggcttaattaaatatttaaatgatgatttagaaaatcatcggaagctaagtctgtttttagtcggttttagcggtagtgttgttttgtttattcgtgccaatatgattgctatttggtgtattttcggattagtcttgttaatcaatttgttaactagtaaaaatagacggggaagcgatttattgataccaatccttggaggattatttggtatctgtctttttacattaattgcatttatgagttcatcaacttcagaaatgatccaacaagtttttattgcgaatattaaatatgcagattctacattgcttgataagcgcgttgctacacagtactttatagattttttaataaaatatggattaatagcattagttataagtggtattgtggttaaaataagccggtatactgagttaacaattaagcaaaagaaaacatttatttggttgatagggtacttcattgttaattggcttacagtagtagcttcaggtagaaattaccaacactatctaataacacaaatacctgccattcttatttttgttggttttgcacttgaagagctaatagggaaaaagacaaataaatggcactatctacttgtaatagcaattttaatgatgagtattcaaggacacgccctgtatgaacaagggaaaacagcattggttgttaataactcgaaacaatttgaaaccaatagaggtatcaagagggtttcaaattatattaaacaacactcaacaaatagggatagtatatatgtgcataatttagatgcaaatatatacttagagagtaacagagtgtctaattctagattttttgttttaccttcgttggattatcaaaaattccctaagatatcaaaggaatttagagatagttttattaaacgaaagccaagattcatagtagtttccaatagtattagtcagcaacctgattttagatttaacggtttcatcaaagcgctatgtgatcatcaatacaagcgggtttatgttgatactagtggtttatctgtttttgaattaaaataatttaatcgctaaaggaatgaactaagtgaaaatacttattgtaagtcagaatttttatccggatgaatttaagataaacgatatagcgacatcatttgtaaaatctggacatgaagtgacagttttaaccggattaggagattatagtaccggtaaagttcctaagcgttatcgcttatttaaaaatagaaacgagcaattaaatggcgttaagatacatcgtgtacgcgcaatcgcacggcgaacggggccgatttttagatcattgaattatatgtcgtttgcaattaatggctggttctgggggaaatggcagagacaaaaattcgatattgtctatgtatatatgatttcaccggttacaatggggataccagcaatggctgtagctaagaagcaacatattccgttggctatttacaatcttgatttatggccagagtctgttaaggcgatgagaataaatgaaaataatatagcctttccgattattcataaaatgagtcgaagtatatataaagcggcagacacaattgcagttagttcagtaccgtttatcgattatttagaaaaagttaatcagatagctagtgaacgagttcgatttattccacaatatgcggatgaacagaccgacattcaagatgataaggctattattaaaaataaagctaaaaataactttgtctttactggtaatatcggattggttcaagatattgaaacgattattgatgctgtcgcagccttaaaaaaacgtggcgtacaaagtacggctattcggattcatttagttggagatggcagtcagttacaagctattaaggatatggtgttaaagatggccctgacagattacattatcttttatggaagacagcctagttcgcatatggcttatttttataaggaagcagacgcgtgtttgttgacattaaaaaatgagaatatgattggagcaaccattccagctaaacttcagggatatatggctgcacataaaccagttattgcggcgattgatggtgatgctaagcgagttattatggaatcgaagtgcggttttcaaacaacagccagtgatgcgcaaggattagctgatattttattaaattttatgaaacttactggcccagagcgtgacgaacttggtgaaaatgggtataattattttgaaaagcattttacgaaacagagatttatgatggatacagagcagtggttattgaatgctatagatgaaagaggagataaataatggcaaacgatttttttaaggataaggttttattaattacgggtggaacaggttcttttggtaatgctgtattacggcgctttttagattctgatttgaaggaaattcgtatcttttcacgtgatgaaaagaaacaagatgatatgcgtcgtaaatttcaaaatgataagatcaaatattatattggagatgtacgcgaccgtgatagcatcagtcaagtaatgcctggtgttgattatgtattccacgcagcagctattaaagaagtaccttctgccgaattcttcccaatggaagctgttaaaacgaatattatcggaacggataatattttgacaagtgctattgcaaataaagtaaaaaaagtcgtttgtttatcaactgataaagcatcatatccaattaatgctatgggaatctctaaagcgatgatggaacatgtttttattgcaaaatctagaaatattgatccagaagaaacgttaattagtggaacgcgttatgggaatgttatggcttctcgtggaagtgttattccattgtttattaaccaattaaaagcaggcaaccccattacaattactgaaggctcaatgacaagatttatgatgaatcttgatgaagctgttgatcttgttatgtacgcattccaaaatgcacaacaaggtgatattatggttcaaaaagcaccggcagcaacaatcagtacactagccgaggctattcaagacatattcggtagtgaagcgcctatccaacatattgggatgagacatgcagaaaagatgtatgaaactttattgaccaaagaagaagccgctagagctgaggatatgggagaattttatcgtattccatcagatcgtagagatttgaactatgaaaagtattttgcggaaggtgaccaaaaagcagttgatattgaagaatacaactcagataatactaatcggttatctgttgaagagatgaaagctaaattattagaattacaattagtacaagatgagttaaagaaatggaatgataaaaaataatgaagatattagttacaggttctaagggatttgtaggtcgtaatttgataacacaacttaataacgaagactatcaagatattattgagttcaatcgagaagatatgctatctagcctagaatctaaattagaaaacgttgattttatcttccatttggcaggtgttaatagacctaaagataacaccgagttttatgttggaaatactgatttaacaacgcaattaatcgaattattaaaagctaaaaaaatgagaacgccaattatttacacatcatcaattcaagccgcattggataatgattatggtaagagtaaaaagatggctgaggatcagttattcgaatatgcccaaacgcagtctacaccagtttatatttaccgacttagtaatttatttgggaagtggtctcgtcctaattataatagtgttgttgcaacgtttgcacataacttgacacataatataccgttacaaattaatgatcccgatgtgactcttaatctaaattatattgataacgtcattggtgattttataagaacaatgaaaaatggccatcccacaaaagagggacaatactgtattgttccagaaagttatgaaataaccgttggcgaattagcgggtaaattacagaagtttcatgataaccgtgaaacattagtaatgccttctttaaaagcgcaatttgatcgtgatctatatggcacttatttaagttacttaccggaagatcaattctcttattatttaaagaagaatgaagataatcgtggttggttagctgaatttattaaatctgaagataatgggcaaattttcatttcaacaactaaacctggaattacacgtggaaatcattggcatcatacgaaggtcgagaaatttttggtaattcagggaacaggtttaatcgagtttcgacaagttggaaccgataagattctaaaatatcctgtgtctggtgataagccagaagtggttgatattcccgtaggttatacacataatattagcaatactggggcagaaacaatgattacattattctgggcttgtgaaatatttgatcctgaaaaaccagatacgtattatgaaggagtttaagatgaaaaaattaaaagtaatgacggttgttggcacgcgtcctgaaatcattcgtttgtcagctgttatgaatcgcttggacgaagacgaagctattgaacaaatcattgttcatacgggacaaaattatgattatgagttaaatgaagtattttttgaggacttccatttacgtaaacccgactatttcttagaagccgcacagggtaatgcaattgaaacagttggtaatatcttaattaaaattgatccgatattagaacaagtacaacctgatgcttttcttgttttaggagatactaatagttgcttagcagctattgctgctaagcgtcgtcatattccaattttccatatggaagctggtaaccgttgctttgatcaacgggtaccagaagaaactaaccgtaaaattgttgatcatacagcagatatcaacttaacatatagtgatattgctcgtgaatatttgttaaaggaaggcttacctgcagatcaagtaattaaaacagggagtccgatgtttgaagtattaggaacacgtaagaacgatatcgaaaaatcagatattttagaacgactttccttagaaaagggacaatattttgttgtttcagcacatcgagaagaaaatattggctcagagactaactttaatgacttggctgctagtttaaatgcaattgcagatatttatcaattaccggttattgttagcacacatcctcgtacgcgtaagatgattgaagaaaaaaacattcaatttaatccactagtaaaaataatgaagccaatggattttaatgactataataagttacaattatatgcaaagacagtattaagtgacagtggtacgattagcgaagaatcatctattctaggattcaaagcgctaaatattagacaagcacatgaacgacctgaagcaatggaagaagcttctgttatgatggttgggttaaaccaagaacgtattctacaaggattgaaagttctagaaagtcaaacacctgatactttacgacatgttgctgattatagtatgcctaatgtgtctgaaaaagtattgcgaattatcttatcatatactgactatattaaccgtcgtgtttggtttaagtcatagtctaattaagaagcctctctattttaaaggggctttcttttatatctaattcaatgattaaggaaattaaaaatgaaaatactacagattaattctgttaacggcatgggaagtacaggccggattgcagttgaattagctaagcaacagctaaaaagtggtatgacacccgtgatagcatatggacgtggtaccgaatccagtgatttgagtataccaacaattaaaattggggctagtcaatttaatatctatgaacatttagtcgaagaacgtttttttgataatggtggatttgcatcaagacgtgcgactaaacagcttattaaaagaattgagaaatttaaacctgatattgtgcatttgcataatttacatggttattatcttaatactgcgcttttattcgagtatttaaggcaaagtgattgtaaggttatattaacgcttcatgattgttggccattttcaccacagagtgcctatattgatcgagatcaagatgggaaagtacctaacaaagttcaaagtaagtcggagtttaatgaatatcctaaaacttactgtcgttttagaagtcagtcattatataataaaaaggttgcagcttttacagtattatctaaagaacgttttaaaatagttacgccttcaaactggctaacagatttagcaaaagagtcatttctatgtaaatatcagattgaaactatccataatgggattgatttaaatcaatttaaaccaacgacggaaaattattttgaaacgcattatcagttaaaaaataaaaagattattctaggtgcagctaatatttgggaaccacgtaaaggattggtatatttcgattatctagcccaaaatttaccaagtaattaccaagtggtagtcgttggaagagataccgatcagctacagtcggataacattcttaaaattcaacaaaccaatgatatttctgaactagctaatatttatgcgagtgcggatttatttgttaatccaacaatggctgagaattttccaacctcgaatattgaagctcttgcatctgggacgcctgttattacatttaatacaggcgggagtcccgagagtctcaatattgaagtaggtcgtgttgtgccaaaaggggattcagaagcgttacttcaggcgtgtttggggtttgagaaaactgcagaagttgttacagcttgtgttaagcaagctcataaatttgataaagaaattgcatatgatcgttacattgcgttatatcaatcatggaatggggaataattaaatgactaattatctagtagtaggttctggcctttttggcgcaaccttcgcatatgaagccgcaaaacgcgggaatcacgttaaggtgattgaaaaacgcgatcacatcgctggtaatatctataccaaagaagttgatggcatccaagttcaccaatatggcgcgcatattttccatacaagtaacaaggaaatctgggaatatatcaaccaatttgctgaattcaaccgttatacgaatagcccagttgctaactataagggtgaaatctataacttaccattcaatatgaatactttcagtaagttatggggtgttgtgacacctgacgaagctgctgctaagattgctgaacaacgtaaagtgttaggcgataaggaacctgaaaacttagaagaacaagctatttccttaattgggacagatatctatcaaaaattaatcaaaggctacactgaaaagcaatggggccaaaaggctacagatttaccagcattcattattcggcgtttaccagttcgtttaacctatgataacaactatttcaacgatacttatcaaggcattccaatcggtggttacacacaaatcattgaaaagatgttagataacgatttaatcgatgttgaaactggtgttgatttcttcgataagaaacaagaatacatcgatcaatacgacaaggttatctttacagggatgattgaccaattcttcgattatcaattaggggaactagaataccgtagtctacgcttcgaaacagaagaaaaagatgttgataactatcaaggtaatgcggtcgttaactacacagatgctgaaacaccatacacacggattattgaacataagcattttgaattcggtaaaggtgacaaaaacaaaacaatcgttacgaaagaatatccagcagattggaaacgtggcgacgaaccatactacccaatcaataatgataaaaataatcgtctatacaaagcatatcgggatctggcagaaacagaacctaaagtggtctttggtgggcgattagggcaatatcgttattatgatatgcatcaagtgattcatgcagccttacaagttgtgaaagatgaattaaaggattaagcaatgaaaattattaaaaattatctttataatgtgttttatcaggtctttgtgttattagtaccacttataacgatgccttatattgcccgtgttttaggcccaacgggtgttgggattaactcatttaccaattcaaatacacagtattttattttaattggtagtatcggtgtttcattgtatggtaatcgccagattgcttattatcgagatgataaagcgaaaacttctcaaattttttgggaagtttttctaatgagaatgattacgattcttgtagcactagcagcattctttattttcttagggttcgagaaatcttatcaccaagcatatctgatgcaagcaattttaattgttgctgcagcttttgatatttcatggttctttatggggtttgagaatttcaaggtaacggttcttagaaatattatcgttaagttaatatcgttagcctgtattttcatatttgttcgtgataaaggtgatttgacattgtacattgctgttttgtcaatttctcaattaatcggtaatattacgttatttccttatttaaaacgatacattaacttaccaaattggcgagaattaaaaatttggcgtcattttaaaccttctttagttttatttgttccccaaattgcaacccaattttacttgattcttaataaaacaatggttgggaagatggtatcagttgaagcagcaggcttctacgataattccgataaaattatcaagatggtattagcgattgtaaccgcgacaggaacagtgatgttacctcgagtcgctaatacatttgctaagggagatcatgaacaggttaaaaaatacttatatcaatcttttgattttgtgagcgccatttcgataccgatgatgtttgggatggcggccatcgctcctaaatttgctacgatgttttttggacaagcatttgatgcagtaggaccactaatgatggttgaatcgttagtaatattatttattgcttggagtaatgtattaggtgttcagtatttaatgccaacaggtcataataaagagtttacagtatctgttacaatcggagcagttgttaatattattttgaatattccgatgatcttatggttaggaactttaggtgctatgatttcaacagtattatctgaactgagtgtcactagttaccaattatatatcgtaaaagatgatctaaacttacgtgaaatgttgcaagagttttggaaatatttgttaagtggtctgataatgtttgttgtcgttctaacaatgaatttgaaattatcgtttaatatgacgcaattaattattcaagcggtgatcggaataattatctattgtagtattttatggataacaagaccaagaatcttaaattatttaaagaaataaaaaaactcacagttttagttagatgcgtttttaaacgcttgaactataactgtgagttttttaatacaattaactgatgacttctaaagcccatttacgtgcattgtaaatactttcgaattgagcagagttaatccagtattgaccatcaattggatcactgacatgataggcaccagctctataaccatctactaaaacagcatggttattattagtacctctgccccaccaatattgttgataaattggttttttaaaatgaatcgtaacgtaagcaacgacgggatgtaattgatttaagctatctttaatttgagttgtagaactacctgatatattgcgaacattaccatatgcttttgcccagttagttaatggtgcagggaaaatagcttcaaaagcaccaggtctactgtagtaaggcgaaccaccaaaaccatgattagggtttaagtcagttgcaataggcatagttcgaagaaaggatgggaaggtataaccctttaagcgccctttatcgcgaagacccatatataaagaggcagcttcacaaccgttaggtgcgccggctgcatattgattgatatagccagttttcattaacacttcatcataggctgcaaaagcgcgtgtattcatccagtaataacgatcgccgtatttaaagttatagtagtactcaccattgctaaccttatatttagcaacagctcggacgactttccccttaacctgtgagccactaattagatatttggcatctggaagaggagaaggggtattgaaaccaccataattccctaggttaacaattaaattaagattgactgtttccttcgaaacaattgctgcgacatcagtaaatgcacgtgtattagtccagtaataacgattaccaaacttaaagttgtaataccattccccattgctgaccttatacttagcgacgatatgaacaacattgccactcaattgactgccactaattaaatatttagcaccaggaattggggatggcgtattgaatccgccataattatttgctgtaattcgagcatccttattgactgattctttggccactattttaaatgttggcgctacatcactaaaggcgcggatgtccatccaataataacgactaccatatttaaagttataataagcagttccatcactcaatttatacatcgctactgcagtcacttgatgaccgttcagttgactgcccgcaataaggtttttagcaccatctaaagtagctggtgtgttaaaaccagcatagttactggtagtcactttaactggtttattaagtgattgtttggttgtaattttaaccgtattaacgtcagtgaaggcgcggatgtccatccaatagtaacgactaccatatttaaagttataataagcagtcccatcactcaatttatacatcgctactgcagtcacttgatgaccgttcagttgactgcccgcaataagatttttagcaccatctaaagtagctggtgtgttaaaaccagcatagttactggtagtcactttgactggtttgttgagtgattgtttagttgtaattttaacggtattaacgtcagtgaaggcgcgtacgtccatccaataatagcgattaccgtatttaaagttgtaataagcagtcccatcacttaatttatacatcgcgaccgcagtcacttgatggccattaagttgactacccgcaataagatttttagcaccttctaaagtagctggtgtgttaaaaccagcatagttactagtagttactttgactggtttgttgagtgattgtttgttcacaatcgttactttatttttagtagctacacttacaactggcacttctgtaaatgcacgtgaatccatccagtaatactgatccccatacttaaaattataataagcagtgccgtcgctaaccttatataatgcaacaactcttacattttgaccattaactttatcccctgttaataagctcttagcatcaggtagagttgctggtgcgctaaaacccgcgtatacattcgttgtaatttgcatattcttggctacatttaatttctgttgaatcgtaaccggagcccatgtagccccatgaacgtcattggttaacaatgagcttgctgaaactgatgttgcaagtcctaaagcaattaaaagtgcttgataagactttctcattaaaatcccccccaaaaagtatttatacttaagcccccttagtatatactgtaggtagttctaatagcaagcgtatttttatggtactataattttatttagggggatattatgaagtataatggaaaatttttaggcttactatgtgttacagcacttgctacaaccttagttaatcctatcgtagcatcagctaacgaactatcagaaagtcattctactgttagttctcaaagtggttcaattattagtgacggttaattaattcttctggaataacgcccaaaacagttgggtctagaaaactcttagcgagtagtaagtcagcattttgtttagccattaaatcctctggtgcatcactcttagcgtaagctggcgtgatatttaaaataatgccgatctgaccatccggcttcacttttctaaattcagcaacagctgctgtatgcgccatcaaggtatggtagccaacctgaacagccttcttgaagtcaacaatgtctggataatgatagcccgttaagtaaccacattcgatatgcacgataggctcattaaaagtcgtccagcgatcaaccaagtcaccaaacaattcaaacgcagtttttgcgtagaatgcaaaggcatcaactgattcgcgtgtctcccaaccgcccttttccattagccaccaaggcatatcgaaatggaacagattaatgatcggtgtaatgtctgcatcacgtaagcgcttaaaataatcccgataaaaatcaaccgctacttgattaacatgtttgccatcgggcattaatcgcgtccaagcaatcgatgtccgaaatgagttcaaaccaatcttttgcatattttcaacgtcttcacgatacaaccgataagtatcactagccgtgtcaggcccttgatcgctattaaacttatcaggttgcatctcaaaccatttgtcccaggttgatggggacttaccataacttagggaatatccttctgattgaggtgcggatgctgctgctccccacataaaatgctctggaaatttaatcataaacgctactctccttaaatgtaatcgccaacattttatattgtactatttctttaaagtggtcgcacacctttctcagtcgattatttaatatacgtacctccgaaatattatacacgttaaataaattgcagactgagattaataatatgcattattataaaataatttattttttagggttttacatgtaaaaaggttgtaaacccccgttattttatgatatattcaataatagaaatgattaatactcccccaagtaagatcatttcaatattcagaagatactcgatataggcctttcccaattaaggtttatgccgggtttttttgctttgaaagcaaaaaaaatagccctgacggactatttttagaagcggtttgttatgcaaaaatcatttggaaaatacctgcgccacagatggcaccgataattggtgcaacaactggcacccaagcgtaactccattgtgagtcgcctttgttcttaagcggtgtgaacatatgcaccaaacgtgggcctaaatcacgagcaggatttaaagctggtcctgttgggccacctaatgaagcaactaatgtcatcaccaataaaccaacaacaatgtggccggcagcgccaaacttacctgcaccaattgctaaagcaccgaaaactaagatcaatgtgcctaaaaattcatttacaaaaccattcatccggctatgagcagcatcgattgttacgaatgagcccaagattccttcttggtttgttgtgcgatcataatatggtttgtaagcagcaaccaataataattgaccaaccattgcacccaagaattgaacaatgatgtatggtaaaacattttcccaagggaataagcccatcactgcaaaacttaatgtaacagctggattaagatggttaccggaaatgctcccaaacataacggcaggaatcataaccccacaaccatatccaaaagcgattaaaaaccaatcactactaaaaccttttgttccttttaattcaacgttggctactgccccgttaccaaaaataatcataattgcagttccaataaattcggcagccaaacgggttgtcaaagaagcgtccactactattcctcctataaatgattcatatttttacgtatcatattataatacgggaaaatgcaaggaaaaacaattgacttttctgtttaaatccctttcatgagaagattcatatttttacagacctttctgtaaatttgacttgctaatatctcataaaatgggatagtattcattgattaaccatattaaccctgattatccgattactgttttggaggttactatatgaacttaatactcgccatcgttctttatgcaggccttgctgtctttgcatttggcattatcctgctcctatttttcttaatttttaaaaaacggcttaaagcccctctaattatttgcttgattggtttgattatcgcggcatctcctgttggctataacttctacatggctcagaaagaacaccgcgaagaactagcgaagattgaaaagaaagataaaaaattcgataaagctgaacgccaattcatcaaacatattaaaaaatcgactgttgccactgaattcatcgctcaaaagtataataaagtttggggcgagttaacagaaaacggaacagttaacgtcgcaaatgttgattataacgattatgatagtgctgttgctgctgaaggtcggcgtttactagcacaaggaaaactcgatgacgctgatgattactatgtcagtgctcaaggtgactaccaaaaaatgaaagactacgcgactgataacaatcgccaagaactcgtttatgccaaagatgtcttatccaagactgggtcgttcgtctctgttgcaacccgtccaaacggaactttccaagaatacactgatgatgtttacaaggctaatcaacgacatgtccgcgcaattcagaagttgaaattctcttacagtagtattaaatagtgaatatggtgattttgaaaaaaagatgaaatgggttacaatgaagtagaagactggggagtctcttatttttcgattcatagttaaccctattatcgattggtagtgtgagagatgcgtcacgtcaaattattattcatgattttaggcctaacttttattttaaccgcttgtgggaatccggttaaagcaaagctccacgaaacaaacagtggcttcaatgcgaaaatcactggtaagactaaacataaaaaggtttattggcaaatcggtgataccattcatacgactaaaacaaccgatgatgctttcacattcgaagtcccttacaaagctatgcagtaccggattacacttgctgataatgaagaaatgcgtaatccaacttatgttgaaggccctgtcgcaaaagaaattgtgcaatggccgaactttattcagatttataatccgattgcccaacaaaaaggactgggcgttttcgaagcgaatccacttgaaggcattcgcactgatcaagttgacagcaacaacgtgattgccatgaacgtcagtgatagcaaagtactggggatctcaattaaagctctcaacgcaggtaagaatctaacgtttaaaaactacgtcctcgccttttcaacaagtatcggaaccaaaccaacccagattactgaattggtcgaccgctcacttaagaaatctgggtcattaatgcaactgacggatcgcgaagttcgctataccgttatgacgaccaataacaacaagcaacaagtcacacaactttcaattaatcatttataaaaagaaagccgccgaatctacgattcgacggctctttttttatatagtggttaaaaaatttcgggagaaattattcacattcttattatagggcgcagttcaatcaaagtaaacgatacggtcggcacaaattagtggtgccaaattgttatagccactcaaccagctatcccctatcgaatttaaagtgcttatttacggcgtttcttcgtttaaaatgctatattgaaggtaaataaaggaggtcttttttatgtttaattatcagcatattcttatcggtttagatggttctgagttatcagaacgcgctttcagtgaggcgattgaaattgctaaacgcaataatgccgaattagttgtggctcaaatcattccagataccctttacacaaatgcacgcatgacttaccctgctgaaacaacgacatctgaaaaacatttcgttcaatcgtatcttgatcaaaaggtgcaattcgctaaagaacacggtgtccctaacgtacgagccatccttaaagtgggttcaccacgtcgtgaattagcctttatcatcccagaagaagctcatattgatttaacagttctcggtgtcagtggtaagggcgcctttgagcggctcttaatcggttctgttgcacaattcatcagtgttcattctaacaccaacgtcttattaattaagccttaagccggtttaaagattggttaagtttaatgctttgtttttgacgtgtcccatttctaatatataataaaggtagtttaggagtggttcgaaatgccgtttgatatcactaaattgtctgatcaaaatattaagcgctggttcttacaacatcgccaagtaatcgttgcaacccttttgcacccaaacacttggtgggcaagttttaatcgccaattaatgcgctttttccaataatcactaaaagtgacgactgaatttgccgtggtcactttttttaatgacgtttttttaaaggagttctgaccgatgaccgagcaaacttatacttttacagcctcaatccaagccgcgacgattggtaaaggcggtgcgtatgtccaatttcctggcgatatccgcgcaatcttcgggaagggtcgtgtaaaagtccgcgccctttttgaccaacaaattccctatgatggcagtattgtcaatatgggacttaaaaagccagatcgcaacatttgttacattcttggggtccgcaaagacatccgtgcacaactcaaaaaagaaattggcgattccatcacagttgaaatccgtgagcggctatagctattactcccctttaaatgctatactattttaaatatttatttcgtcgactaaatttagaatgaggattatcaaatgccaaaacacctttacaagcgcgtggcagtcgttttaatactgattaccaccctttttttatggcttttcacaggaccggccagaagtgaggccgggatttggttcttccataaaaccacaccccaaaaaattgttaagaaaaaaacacccaaaaaaacgatgctcgatatcacacctatttcacaatttcctgaattaccaaccggttgtgaaattacggctgttgccatgcttttagattaccgtggcgttgacatgagcaaaacagaagtggccgatagtatcccctatgtcaatgatggcgatatggaggtcggcttttgggggaatccatacgatgatactggctacactatgtatcctcctgcttggacaggattcttctatcaatatctcggcagtttcaccgatttatcggacgaaccgattagcacgctcaaagccactttaaaacaaaagaaaccaattgtcgcttggattaactaccataaacaaccagcgcattccgtcttattaattggctatgatcaaaattcatttacctttaacgatccatataccggcaaacgaaaaaaaatctcatttgataaattctggaaaattgctgcaccacagggacaccgtgcaatgacttattaatcattaacttgggggatttaacatgcataaacgaaccattgcagtcacgttcattactttaagtagtctttcattagctagttgtcggtcaattaaacctgatcaacaagccgtaacccactctgaaagtttagcacgctatcgcgcctcatcagaagcaaaagaaagcaatcagcgtcgatcaatcgctagctcgaaagaagcttctattaaacaacaatcagaaagtatcgttgcagcttcaaaatctattgaacaagcaaaacaacaatctaatcagtcaacaagtaccaaaaaagcgctcactgccgaccaacaaacttctgttaatcaagcttttctagcgtgggcggctgggcgcgccacaattggaaacatggccgtcagtgattggtattttgaccacggtgctgccggatttggcgattggttcgccaattcacctgatggccgtattttagttcaacctgggacagcaagcccagggtttaatgcctaccctgttcatgcaattggtggctgtgtcttttataccgctttggatggaacagtcggtaaagataatttagattgtggatcattcgccgataactacagccttaacatggcaatggacaaaccggttagcaaatacctactcggtgataacggcgtcgtgtatgaacttaaattaggtaatggtcacctcacatcaactaatgatggtttcagcgaactaaaagatgacggcaaacaagcttactcagaaccacttgcctttgccgtttctgaagacaccgctgcccaagctgaactaaaatctttacttgcttaactattagagtttaaaggagcacgactatgaacaatgccgaactacaggcctaccttgaagaacattcccgcgtcatcaatacatttcgagccaaaggtttagactaccaaaatgaaaagaaccaaaaacgccaacctgccagacgttggaacgagaatagggtcaatcgggccgttgataaaatggtcgccgaatttatcgctagtattcaagtgaaaatggcattcaacattcgtggtgaacacgccaaagaatatcaaacttggttaacgttcattgaacaaaatgaagttgtcgaaggcttggaagaatcggttaatgaaatggcgtttgaatattagaaaaagtagtttcttttaacgaataattttccgcaaagtaattgcactggataatattaagggcgttgaattgttaattatccttgtgattttcttatcaatattatatgatttatttacgaaaggtggttttaaattatggttaagttattctttaacgacggctcaaaaattgcgctccaacaaaatgacacattatctgcctttggttctacgaatggtttacgccataagttgaccatcaaagactgtggtgctgcagatatcgtcgcaaaaatctcgcactttgttaaggacacgccggcttttatcctcgaaaatagtcctagcgaaacttatcacagctcaaatctcattatgattactacacgttaattaaaagactgccgttgggtggtcttttttattttataactcaaaaacgccgctctcttgagcgacgtttttctttcagattaactttattgatttaaataattatataagccgcgcatggtcgcatccgccaacgttaatggctgcccatccaacgtcacccgcttaattgcgacataatcttcgaaatcgggtacttccagttgttgatttgcgacaaattcagccgctttttgataaaccttttcagcgttcgtttgaccgttgacatattgaatgactaacattgccatcatctccatttttacttttaatattattgatgaattggttatctttgataaggtcattatactttgcttactaaaaataagcattttatatattttattctttatccgtattaaacaaaaagcatttaatccatttattttagaacaatgcaccaaatactgcaccatttcataaaatcaatagactaaatgctttaataaaagtcgaattttatctttataaacgttgaattataggcgttcgtttaattctttgcctaattcttcaaagccgggtttgcctaataaagcaaacatgttcttcttgtaagcttcaacacctggttggttgaatgggttaataccattcaagtaacctgagattgagacagccatttcgaagaagtagatcatgtagcctaatgtgtaggctgtttgatctgggatgttaactgacataacagggacgccgccatcagtatgtgctaagacaacaccttggtaagctttcttgttaacgaagtccattgtgtggccttctaagtagcctaaaccgtccaagttcttttcatcagttggaatatcaatgtcgctgttagggttcacaacgttgacaactgtttccatcaagttacgacgaccttcttggatgtattgacctaatgaatgcaagtcagttgagaagttagcacttgaagggtaaatccctttttggtctttaccttcagattcgcccatcaattgcttccaccattctgagaagtattgcaatgttggttcgtagttttctaataattcagttgtgtaacctttacgataaagaatgttacgtaaagcagcatacttgtatgcatcgtttttcataacgtctgtatctgtgtattcagtgcgggcatcagctgcacctttcatcaattggtcgatatccccaccagcaacggcgattggtaataaaccaacggctgttaatactgagaaacggccaccgatgtcatcaggcacaacgaattcttcgtagccttctgcatctgattctgtcttcaaagcgcctttagcacggtcagttgttgcgtagatccggctcttagcttcttctttaccatatttcttgatcaacttgtctttcaaaacacggaaagcaattgaaggttcagttgttgttcctgattttgagataacgttgattgagaaatcgcgatcgccgatcaagttaactaagtcgtttaagtaacttgaactgattgagttcccggcgaataatacttgtgggaagtcacgttgttctgctggtaacatgttgtagaacgtgttgttcaagaaatcaattgcagctttggcgccgaggtatgaaccaccgataccaattgcgatgaagatttctgaatcgctcttaattttagcagcagctttcttaatgcgggcgaattcgtccttatcgtagttcactggtaaatctaagaaaccacggaagtcgttgcctgcaccagtgccttcacgtaattgtgagtctgcagcattaaccattgcttgcatttctgcaagttcgtttgattggacaaatttgtccaaacgggatgcatcaaatgaaatatgtgccatatttgtcttattcctcctgtttttaaacacaagtatacgttaataactttagcttttttagcgctaaaaagcaagccagatcgaccgctttttcagactagacccacctttattttcaaaagaaaattactcaaagtccttgacttgtttcacccatcccgctatacttcaaatcatcaaataaaacggaggttactgaaaatgacaaacactcacttagtacaattgaatattcgttggcaaagccgctaagtgagattgtatgccgttatggatacagtcttttgattgtatccatgcggccattcatcagtaatcgattgaattttaagcctacatggattttaactcgaggaaatccatgtaggctttttctgtcccctacatgactgtcatgtgggggacttttttgtttgataataatgagtgcgttcaaaccgggtatatttcgaacactagcctagtggtgcgaatgaacgacgcagtcggtcgtttgtgcgacgtagctaggcacaggaatacggtttgaaaagcacgttaaaggagctttcgccatgtctaaactcaaacgttttttacccctcattctaattttcgggagtttgctcaccctacttggtatcaaaaaaatcaaagaagccaaccaacctaaattgccaattgtcgggattttacaacctttatcccatcccgcacttgatgaaattcatcgcgggattgtcgctggtctagcaagcgaaggctatcataacaaccgtaatatcaaaattgattttcaaaatgcgcagaacgatcaaagtaatttacgtctgatgagccatcaattcgtcactgaaaaagccaaagtaacggtcggcattgccacccctgccgcacaaagcttagccaatgctactaagcaattaccgattatcttaggcgccgtgactgatccggcgagtgccaatctcgttaagaacaacgcccagcctggtgccaatatcaccggcgtgtccgatcaagccccgattcaaaagcaattggcattaatgcaaaccatcatgccgcaactgaaaaccgtcggcattctctattcaagcagtgataactctgccaccagtcaaatgcacttattcaaacaacttgctgaacaaaaagggctgaccgttgttgaggccagtcttagttcagtcaacgatctggaacaagtcagccagaatctagtcccaaaagtcgatgcaatttacgttcccaccgataatacgattgctagtgcaatgggcaccctcgtccatgtgaccgacaaaaccaaaacgccagtctttccatccgctgaaacgatggttaaagatggcgggctcgcaaccgtcggcctaagccaatacgacttaggcgttgaaaccggtaagatgaccgccgccgttttaagtggtcgttcaaaacccgcaaccactccaattcggtatttacgcaaaggacatttagtcttaaacctcaaaaaagcaaaagccctccacatcacaattccgcagagtttaatgcaaatcgctaatcaaaaaggagctgttctcaaatgaatcttattatctcaaccattgaccaaggattattatggagcctactaagcctaggcgttttcatcacctttcgaatcttaaaattccctgacatgaccgttgaaggcagtttcccgttaggtgcagccctcagcgctttaatgttgcaacaacataacattgccttttccctattagtcgcattcatcggtggctgtttagccggactcgtgacggcaattttatacaactacttccatgtccagagtttgttagccgggattttaacgctaaccggtttgtattccgtcaacttgcggattttaggccaagccaacatggcaattggtgatcaacacaacctatatcaactgccgctattccatcaattaacgctcgatcaacggctcttagtcattaacctagtcatcatgctgatcgccctattattactggctggcttactctacaccgaattcggtcaatccctgattgcagctggtgataatcccacgatggccctctcacaagggattgccgtaaagcggacgaaaacgattgggatcgtgctgtcaaacggcttgatcgcccttgcaggtgggctcgttgcacaatataacggctttgctgatgtcaacatgggcatcggtgtgatggtcattgggttatccgcgatcatcattggtgaacggctccttgtcggcaagcatttcatcgccaaactaattagcattatcctaggaagcgtcgtctaccgcctcatcttactccttgtcttacaactcggctttaacgccaatgatttcaaactcttctcggccgtcattttggccatcttcatcatcgcaccacaacaaaagaaaggactgactaccaaatgaccccgcgtatgactttaaaccacctcaattttgaagttactgataataatgaacctaaacaactcttaaatgatttaaatctcacgattaatcctggtgaatttgtcgtcctccttggcgcaaacggtgcaggtaaatcgactttttttaataccattgcgggtgatttaacccccacaagtgggcaactactattcaacgaccacgacattacgaagcaatccgcccaacaacgcacacggctcattagtcgtgtctaccaagatcctaagttgggcaccgcagctgatatgaccgttgccgaaaatattttgttggcgatgcgccgtggccaacgccgccgcttatttccccggcgtctcaagcaacaactcccacaaatcaaagcgctcgccaagacactcccgaatcacttggatcaacaactcaatcgcccggttagtaacttgtcgggtggccaacgacaaacgttaaacttcttgatggcgacgattcaaaaacctgaattgctgttattagatgaacacacatctgctttagatgcagtttccagccaagcattgatgacttttaccaatcaaacaattcgcgataaccaactcacctgcctaatgattacgcatgatttagaggatgcgttgcaatatggtaatcgactcttggtgttaaaagccggtaaactgattgccgacttgaacgcgactgaaaagcaagcattaactgtcgatactttactagactatttaaactaatcaaaccgcgctaaccattttcggatagcgcggtttttgctgcttaaatccattcaatcttatcaagcaccaatttatcagcggttaattaattaaggatatgattaacctacgtttaacacttgtaatcgttttctaagtatgctaaattattcccataaggttgtgcgcaacctaattattgatttaagggagatctgtataatgacagttactactcaaaaaactattccagctagtgttgctatgcttagagttatcgaatcttggggcgttgatcatatctttggttaccctggtggctcatttaactcaacaatgaatgctcttaatattgaaaaggatcgtttaaaatatattcaaattcgtcacgaacaagttggggcccttgccgcagctgctgacgctaaattaactggtaaaatcggggttgcttttggttcagctggccctggtgcaactaaccttttaactggtttatatgatgcaaaagaagatcatgcaccagttttagccttgattggtcaagtaccaagcaagaacatgaactacaactacttccaagaattcgctgaaaacccaatgttctctgacgttgctgtttataaccgcctcgttatgacacctgaaagcttgccatacgttgttgataaagcaatccgtgaagcttacaaacacaatggcgtcgcagtggttgttattccaaatgacttcggctacgttgaaattccagatacaccatatagctcaagctcaccttcagatcgtaaaaaagtggctggtccagtcgcaacagacgaagaagttgatcaattcttagcaatggttaaagacgctaaacgccctgtaattcacgttggtcgtgggattaaagacggcggcgacaagctcgttgaattatcaaagaaacttcaaattccaatcgtcatgactgggcttgctaaagggttagtgcctgatagttatgaaggtaacttaggcatggctaaccgggctgcttctaaagcggctgatgaaatcatggccgttagtgatcttgtgattgccatcggtgctgacttcccatttgccaacttaatttatcggacacatgacttcaagtttatccaaatcgataacgatgaagcacaatttggccgtcaccatttcttagacttcggaatctggtcagatgcaactgcttttgttgaaaaagtaatcgccagaagcgaaacggttgccccaacaccattcttcaaagctgctgttgctgatatggcaaactggcaagcctaccttgatgttttaacgaaccgcgactctgatccgcttgaattcgaaccaatctacaaagaaatcaaccggattgctgaagacgatgctgtcttttcaatcgatgttggtgataatatcatcaacagtttccgtcacttgaacttaacgcctaagaacaaatgggtgatttctgccctctttgcttcaatgggttcaggcgttcctggtgccttagctggtcaattgagctacccagatcgccaagtcttcaacatctcgggtgatggtgccttttcaatggtcatgcaagacttgatcactgaaaagaaataccaattaccaatcattaatatcatcacatcaaatgccgcattaaacttcatcaagagtgaacaagatgatattccaatggattactcaggaatcttcattgaagatcaagattttgccatgattgcgcaagcaatgggcattgaatcaatcaccgttcgttcttctaaagaattacccgctgcctttgacaaagcccttgaagtcacaaaagctggccgaccattcttaattgatgctaagatcactgacaaacggagtattccagttgaagaattagaactaaccattaaagatggtaagataacagaaacaattagcgcaagctatgatgcttctcgtcctgctggcaaagaatacagcgtggctgatttcttcgcagaatacgatggtcaatcactgaagacattaccagaattatttgaagaaaacggtgttgaactataaaacaacccggccatcataaaaatagcgtctcaacacattgcggtgtgatgggacgctatttttattgatttaatttttggtaatggcttctttaggatggaaccaaacgacgttcttgtcgaagaatgagactaagtcgtttgataagtacaagatataggtgaagaataagacccaatttgagccaccctgcattgctgtaatgccccacaacgtgattgatacgatactttggatgaaccagaagtaatagctttctttaaaccgtaatgtggtcaacagtgcgccagtaaacccaactgaagtggcgatactatcgatcaatggtcgtggactgtccgtcatattgctttcccagagatataataacccgactgatatagcaaagaacaatagcgtcaacgcccaattacgaagtcctttaccacgagtagcaagcccccggacttttttatcaacgttttgcgcccaatctggcattaataagactgggatgtctaacataataatgtagacggtttgtaataacatatcgttatagtttttagcattataagccacaataatgtagattaatgcagagatgacaccaaagacaccgtttaaaggtttcgtattcgtaatactaatagtacaggtgaagcctaacatccccgcgagcatcgttaaaaacgacacgccagtcattggaccaccggaaatagtagcagctaaaataaagcctaacccaaacatcaacaaaccataactggatgttgtccaccctttcatctgttgaatgtaccacttaggattaaatacactggtgattgcacgattgtcttgcattgaactgaaaccctctttatatgaatttagttatcactccagattgtcaacaccattttccatatattgatgtaccatctgacgaaacaacactatatatggtacacgctaagcattctaatttaaactcttgtatttaattcaatttgtggtagctgattttaaagcctttttgaaagtgccgttaacttacgattgcaagcgctgaactagaccattcgaaaatattttttatttttagcgttcgttgtcaagactcaattcaatctttgaccaatggcttaatagtctctttgatcaattgaccggagaatgacgtcattaatgcccacattatctggtgtatcgatggcgttcattacggcattagcgacatcggttgctgttaatccagtttcagtttcactcttgagaacagctgctcgtaattgcggatcactaatccggctggctaattcggtttgcgcatgtcctggagagattaacgttgatttaatgcccattccaacttcttccacacgtaacccttccatcaccgcgcgcattgcatatttagtggctgaataaacggataagccttcaccagtgaaatgaccggcaactgaatccgtggtaatgatatgaccactcttttgctgttccattaaaggtaaggcatatttaatgccatatagcgcacctttgatattaatatcaatcatagcctcccactcatcgactttaccatcgcgtagcattgagacgggcattaagccagcattattgaatagcacatcaattctaccaaatttagcgattgtcaattcgattaaggcttgcatgtctgctaattgcgtcacatccgtttgctggtaaataacctcagtgtcgtattgagcggttaacgccgttgccaacgccgttgccaacgccgccaacgcacttgttcgtcgagccgctaaaacaagttttgcacctttggctgctaataaggtggccgtctctttaccaatcccacttgatgcaccggtaatcacaacgactttattttgaatatcattcatttcttttcccctcactttttagttgataaggttagtatatcgggtacttcgcaataaacaattacgcactttcaactaactaacgcacctcaaagtaagttttgtgaaaattatttggagagttgtccgagcggccgaaggagcatgattggaaatcatgtaaatgggtctaacctgtttcgagggttcgaatccctcactctccgttaaataataaatgacatggcccgttggtcaagtggttaagacaccgccctttcacggcggtatcatgggttcaaatcccgtacgggtcatttttttggaggtttagctcagttgggagagcgtctgccttacaagcagagggtcacaggttcgagccctgtaacctccattcggtcgcatggtctagctggttaggacgcctgcctgtcacgcaggagatcacgggttcgagtcccgttgtgaccgtcttaaaaaaagcgtaagcaatttattgcttacgcttttttgttgtttaatcattttaattaaagacgccagtgattaatagcaagtatccaagctcttgtaaatagcagttacgtttgattaggccgagttgtaacgcaattaataataactggccacctgcaaagagaattaaatgccaaccgtgaattaaatgcgttaaaatcactgcaataataatgcacgcccatgctacataactgaggacagtaatcatccgattgtgagtcgttagttcgagaagataaatgatgattaagaataggcctaattttacgagtaaatcctcggggataaagtgaatgccactaaaaatctgagtaattaaaaagaaaaatggggctagtaagaattgaaatgataaccgtaacgtacggtctttgaactggtctgggtagataaaggggattagaacaaaaatgctagtaatccctgatagaagcccaatcagaggtagatcacgccagccgataattgcggctagaataattgcgactaaaagggcagcagttgcaattgttcgctttggtttataccggggtgataagacgagtaaaatggctaatagcgcccctagaatcgcagttagataaaatgaaagcccgaattgctttggaaaaggccacattgtcagtccgacgattaagccgagatttaaataattaaacaaagtcagtaattgtggccgagttgaagcctttagatgttgttggttaaggtagaacaatagcaacacttctttcttagaatatgtgtctcatcttaactttttttgaaaagaaggtcaacggcttttgaaatggattgtattttgtgctaggatagtagagttataagaagttcccgataggattcacacaccgtgaagaggccttgtaaccgacacatatatagggggaaacatagaaatgcaagaaagacatttatttacttcggaatccgtttctgaaggccatccagataagattgcggatcaaattagtgatgccatcttagatgcgatgttagcacaagatccacaagcacgagttgcttgtgaaacaaccgttacaactgggttagtccttgttgtcggcgaaatttcaacaacggcatacgttgatatccaaaaagtggtcagagagaccattaaagggattggttatcgtgatgggcattatggctttgatggcgataactgtgctgtgattgttgcacttgatgaacaatcacctgatattgcacaaggggtcgatgattcagttgaatcccgtgcaaaggatgaagatccacttgataagattggtgcgggggatcaagggttaatgtttgggtttgctgtcgatcagacaccagaactaatgccattaccaattgccctttcacaccgtttaatgcgtaaagtcgctgagttaagaaagagcgggcaactcgcttatctaagaccagatgctaaggcgcaagtcactgttgaatacgacgaaaacgaacaatctgttcgtgtcgataccgtcgttatcagtatccaacacgatgcagatgtgactttagaaaccattcaaaaggatatgcttgaacaagcgattcaaaccgttattccagccaaatatttggatgatcaaaccaagtatttcattaatccaactggtcggtttgtcatcggtggaccacaaggcgattcaggtttaactggtcgtaagatcattgttgatacttacggcggttatgcacgtcatggtggcggtgctttctcagggaaagatgctactaaggttgaccgttcagcaagttatgcagcccgttacattgctaaaaacattgtagcggctgggttagcgcgcaagtgtgaagtccaattggcctatgcaattggtgtagcgcaacccgtttctgtttcagtaaatactttcgaaacagggaccgtcagtgaagaaaagattcaaactgcaattcgtgaaaactttgatttacgaccagcagggattattcaaatgttagatctacaaagacctatatacaagcaaacagctgcatatgggcactttgggcgtacagatgtcgaatttccatgggaacgtttagataaagtggatgccttaaaggcaagtattgctaaactaaatgcctaatgtattattagacgagtaaaagaggcggcctttccttagcttatttgagttaagaaaaggctctttttatgctcaagaataagagagggagctaagaatggaacaaagtaagggaagaaaaacgaatgtattactcgtgacgattgcgattttcgtcgcaactttcatgacggcgattgaagggacgattgtttcaacggcaatgccaaccatcattagtaatttacacggtatgaaattgatgaactgggtcttttcaatctacctattaacgaatgcgatgatgacgccaatctatggtaagatggcagatcggattggtcgtaaaccaatcttcatctttggtttggccttgtttgtcatcggatcatccttatgtggattgtcaaaccatatggggacgttaattatttcccgggcaattcaaggcttgggagccggggcgattatgccggtatcatttacaattattgctgatatttatccgattgaaaaacgggcgaaagtcttgggttttaatgggtcagcatgggggattgcctccatcattgcgccgcttttagggggcttcattgttgataagttgacctggcattggattttcttcatcaatgtaccgattgggattattacgattggtttaatctggtacttccttcaagaagagaagaagacgagtgctgaaccagtcgactattggggtagtttatggttgatggcggcccttttgagtttactatacggcttccaagtcatgggtgaagccagaccgtcagtgctcgttttagggtcaatgctcgtgattgcagtggttgctttttacctctttatccgcgttgaaaaacatgcacaagatccgattatttcattatcattatttaaaaatcggacatttgttgtccaaaatgcagtggctgctttagtgagtggtttcttaattggttttgaagtctatatgccaatgtggatgcaagggatcctcggattgaaagcctcgatggggggctttgttgtgacgcctagttctgtgatgtggatttttgcctcattatgggcaggcctattacttgttaagcacgcaccacgaacaattctagccggtagtttgtgtattttacttgttgggagcttcatcttagcattggtcccacaaaccacaccgttttggttcttcttattagttgctgctggtttagggattggctttggcttaatcattaccacgacgactgttacggcacaaagcgttgctggtgctgacaaagttggtgttgcaacgtcgtttaatacgttaagtcgaactttaggtcaaaccttgatggtttcagtttatgggattattttgaatcggcaattggcaaaagggattgctggtgatggtcgattagatcaaaacatgttaaatgaattgattaatccagaaactgctttgaacttacctaaacaattattaccaacattacgccatattctatacaatggtttacacttcatttattttgcgtcaattgtgttaattgccattgcaattattattaatttaatggatcgtaaaagaagtaaataaaaaagattgaccaatacggtcaatcttttttattttaatggaataagacacagacgccttcaggtgtttctaagtctttttgacaggcggttaataaaccagtttgggcatcgcgccgataaagcgtaccattatcactattttggttaacggctaatagaaaatcgtcgttagcggaaagattgaagtcacgggggaattcaccatccgttgacatttgttggattgctcgtagttggcgactgtcatcactgatggcatacacaacgattgaattatacccacggttggaagcataaaggaaacgaccgtctttggaaacacggattgcagcgccgccgtttgcttcgtgccaatctgcaggtaacattgagtaggtagcaaccgcgctaaaagtcccatcggctgcatgataatctaagaccgtcacttcactggacaattcacccaataggtaagctgtcttgtgattgggatggaagactaaatgccgtgtgccaaaaccaggttcactcttgtaagttgccactttggttaattgaccagcattgtcgacggcataagttactaattcatcggtgcccaaatcacagaccactaagcggtggtcaggtgttaggtcggtataatgcacgtgggcgctagcttgttcaggacgcggaccatggccttcatgaactgtcgtgctcgctaaggttaaactgccatcggtttggatttgataaacgagtatttcgcctttatggtaattggctgcataaacgagttggcggtcttcatcgactgccacgtatgctggtggtgcgccggctgctaagactgcgttcaaaaagacaggagtgccactagctaagtcataggcagcaatcccaccttggtccccatctttaatgacggtgtagaggatgttgcggtttgaaatcgttaaataggatgcgttatcgagattaatgaatggttggatgtcactcacggttgcagttgttgcatcgaaaattccgcggtagatccctttaccaatccggcgggtataaccaccaattaaaacttcttctgtcataatcagactcccttcgtcaaatactctttgagtatagcatattcctgcgaaaacggtttaatttgttactaaaaggattcactagtcgctaaaactaagtcgcgaatatgctacaatgatactatcttaactaagaggagatttcattatgaacacgcaagcagaagtcatttcaattggcaacgacgccattgatgatcaagaaccgatggtcattttattcgatgaacatgcgacaactgccattcaaaacgtggcattgattcaacattttatggatgaagcggccaaaaaacagctaacactgacgacagattctgcggttattattaatcaacaaccttatacgattacgtatgtgggcgcgttggtaaatcctaacctcaacagtattggccatgtcgctttagtttttggacctgcgccacaagaagatcaactgcaaagtgggctttatttaacaccagccgccgcgggtgttccggctgttcctgaattcaaagtaggaacgcagataacgtatcaagaaactatgtaggaattaggtgaattggtgtgacagagaataaacagccacaaacagaacgttcatggttctttaaatggtttttaaataagaagctaccgattgttttgttaaacgtgttattaacgttgctgattatacttttattaacaaaacttgcttggctgttaaaaccaattcagtcgttgatgttgattgttgggttaccgattattattgcgggcgtcttgtattacttgaccaacccgttaattgattggtttgagcggcgttggcatttaaatcgggtattgtcgattacgattatttttattttaattgttggcttactggtctggggaattgcgacgattattccaatcattcaatcccagacaacgagtttaattgatcagtggccgtcttattgggcgaatattcaaactcagacgatgaaatggtttaacgacccagccttcaaatcgattcaaaaacaattaaacgatatcaatacggatgtgtttagtaatttatcaagtaaagtaaataaaatgctgacttcgaccgttagtcatattggaacagcggtcggagtggtgacgaacgtagtcatcgcgattgtaacgatgccgttcattttattcttcatgttaaaagatggtcaccgaatgaaaggctatttgttaaaattcttcccggttaaagtacgcgccacaactgggaaagtgttggaagaaattaacacacaggtcagtcagtacatccgcggccaattgacagtggcgttttgggttgcagtcatgtttactgtaggctactggattgttgggatgaagtacgggttgacgttgggaattttagcggggattttaaacttaattccgtatttaggctctttcctagcgatggtcccgtcagtgattattgcagcgtttatctcgccgttattattgattaaagtactcatcgtgtttgctgttgaacagaccttggaaggtcgtttagtttccccattggtcttggggagcaagatggcaatgtatccggtcacgacaatcattgtgttgctggcttcaggaaagttattcggccttgccggtgtgattctcggtattccagtatatgcgattatcaagatattaattagtcacctttttgaatggttcaagtcagtttcaggcttatacgagcaataaaaaacgcacgatccgtaatgaatgcggatcgtgcgtttttttgtttttagagcgttaatttcatgtagtggtgggggatgcccgcttccatttcgccttcgctagtgacaataaagcctaattttttcgtagaaaccaatggcgtggtcctgtgcgaataaaataatataaggcgttgtggtgcgtttagcgtcttcaatgatggcttcgattaattgatagccaagtccttggccacggaaagctttgatggtcgcaacgcgctgaattctaaatccaccgtcttttaagacgtgcacgcgtgcggttactgctggatcttgattgaggtaacctacatagtgaatcgtgtgatcttcgtgcgcatcgatttcctgtgtttccggcatattttgttctcggacaaacaccgttcttctaatgtatgttgcatcacgaaagataacactgttatctccaagtgtatgtttaatatccatttgtttcacactcttttctgatcaatgtagacgctaaggttaaaagcgacacgggtaattatacagttgtttcaagtcggattcaaccatttcagagaagtttttaggtacctaactaaaaagagccaaactaccggtttaaaaggtagtctggctcttttaactgttttttaaagcatgtcaccattaaaaattgaatggcgaacaagaacataatcgactttcttcaatgatgataagcgtttaccaccagcataagaaatcgacgattgtaagtcttggcgcatttcggtaagggtgtcactaatcgcgcctttataaggcactaaaatccgtttaccctcgacgttttggtgtgtgcctttttggaattctgaagctgacccgaaatattctttgaattgttgaccatcttcttcgactaatttgccaggtgattcagcgtgccctgcaaagagggacccaatcatcaccatgctagcgccaaaacggattgatttagcgatgtcaccgttggttcgaattcccccatcggcaataatcggcttggtagcagctttcgcgcaccatctgagggctgccagttgccaaccaccagtcccaaagccggtcttgattttggtgatgcaaactttaccagggccaatcccgactttggttgcgtccgcacctgcgcgttccaaatcgcgaacggcttcaggggtaccaacattgccggcaatgacgaaactcttaggcagtacttttttgatatgttgaatcatatcgatcacgacttgtgagtggccgtgggcgatatcgattgtaatgtattctggtagtaagttatccgttgcgagttgattaataaagtcgaattcatcgtctttgaccccgacactgattgaggcaaataagccgcgctcgtgcatcatcttgatgaatgcgggacgcttttcaggttgaaagcgatgcatgacgtagaagtaatggttttcggcaagccagatggcaagcggttcatcaataatcgtctgcatgttagcagggacgactgggattttaaacgtttctgagccaaagcggacgctagtatcaatctcgctccgacttttcacaatacatttattgggaatcagttgaacatcttcgtaatcaaatacgtccattgaaaattctccttaaacacgaacatttattttgggtaatacggaatttatccgtgcataacgtataataacgagcttttttatgaaagtcaaataaaaaaacacattcgaacccaaagaatgggagaatgtgtttgatgatagtgggccttttgtaagttaaacgggttctaatccgcaggagctggcacacgctctatttaatgtaccgcttgcgccagaagcgatagactagcacaccagagatgatcagggaaatgaataaagtaatcaaccaacttgttttggagtgcgacagtggaaggtccacgttcatcccgtaaaaactaaatactaatccggggatggtaagaataattgaataagatgccaagaacttcatgacactattcatgttattattaataattgacgagtaagtatcggctgtttcgttaattattgtgttggaaatttctgccatttcgatggcttgttgattttcaatctgaatatcatcaagcaattcaatttcatcttcattaagatctaacatattggtccgcattaaactagcgagtaccattttatcggtctttaaggacatcatgaaataaactaagccgcgttgaatggtcatcagatcgaagagttcttcattccgtagggaactctgcaagcgagtttcgatttgttcacgagagcggttgatgtcccgcaaatattggagatagatggatgaaattcggaagagaatctggaggacacttctacggtgattttgtggattgaaacctttaatctggccatcaacaaagctctgtaaaaaggtgactggcgttttgttgatggttaagacggtcgaatctgttacaataattcctaagggacttgttttatagaggtatttatctgatttttgcgggtctttttcaagaattggtatgttgaaaataatcagggtcgcattataatcaggatcgtgctcagcacgcgcactttcatcagcatctaaactatagtagataaaatcagatgggatgtggagcttcttagtgagaagctcaatttcttcagtcgagggatcagttacgttaatccaactgttggattggattttagcatgtttggtgagctttttcttagcactgtcgaagcgataggtttcgagcatggtgtcacttccttcatcaataacttactgttaagtctactggatattttaagaatgtaaagtgcggtataaaagaagtgcgttcaaaccgggtatcctttgaggattaacctagtctcgtgcatgagcgacagcgtcgatcgtttgcgggacgtagttaaccgcaaaaggatggtttgaaaagcacgttaagaaaagaagtgcgtcaaaagcggttatcctgtgagaattagcctaattagacgaataagcggcgtagccgattgtttggctaatgtagctaaccggaacgggatgcttttgaaagcacgttaaatcaaggagaatcagaaatttgaaaaaaattgagttagccaagcagtttttaacgacgaacttggtcgtattacaatgtccaatctgtcaggatgcatttgcaagtgtagccgagcaccaattactttgtgtcaatgggcatagttttgacctcgctaaaaatggcacgttatattttttagcaaagcaaatgaagtctgaatataccaaggaaatgttgcaacatcgccgggcttttttacaagcaggtttctttcaaccgttcttaaaagaaattgcatcacggattacccccgatagtttagtccttgatgtcggttgtggtgaaggaacgccagtgcaacagctcaatgcgcaagtttccgcgcgttatatcgggtttgatatttctaaacctgcgattcaattggcaagtgattacaatgccgatgcgtggttttgtgcagcagacttagcgtggatgccatttgctgatcaccagttagatacggtgctcaatatcttttcgccttcgcaatatcaagaatttaaacgtgtcttgaaaccgggcggtcaactaattaaggtggttcccaatgcggattacttacatgagttacgggagttactatatcatggtcaagctaaggaaagctatgatcatggtccagtcttagaattgtttgcgcaacattttccagattatcaagaaatgcaagttcaaaaaacaatgacgttaacacccgagacattgcgcgatttggtcgaaatgacgccattgacgtggacggcttctaaggcacaattagcggcaatcacgctagaagcgctacctgaaatttcattagacgtcacgattttagtgggaaaatgatgagaatttaaagaaagtttaaaaatctgattgcaactctaaaataagggcgctataatgtttttaaggaattttttccctaacttttatcagaatttattttgataaaagctagtgatgaaatgacactaacgtagtttctcgccgtgaataaccgagggactacgtttttttatttgcaaagcaaggtagagcttttgtgaattctattgtataattaatctactgaatcttttttaaggaagtttagaccgtgactaatcatattgtattatacgaaccactgattcctgccaataccggtaatattgcgcggacatgtgcaggaacagatactgttttagatttaatcgaaccattaggctttgaaacggatgataagcatttaaaacgggctggtcttgattactgggaccaagttaagattaattatcacaagaacttggatgcctttttagcaactgtgcccgatcgtcaatatttatacttgattacgaagtttgctaagcaagcttattctgatcaagatgtgtcggatacaagtgttgatcattattttatgtttggtaaggaaacgaccggattacctgaaactttcatgcgtgaaaatgaagatcagtgtttacgaatcccaatgtccgaccatattcgagcattaaacctctcgaactgtgcggcattagtgatctttgaggcattgcgccaacaagattttccaggactcgaaaagagtcatttgtacgacaatgataaattaaaatagggagtgtttttgatgcaaacgaagaaagatccaattactgttgatgcttttcattatgattgtgtttcacctgatgtagaaccacaacaaaatatccaagtgagcttagtcaccatcagcgaagaagatccatatttacaagaagctgatttgagcgcggggaatatttaccaaattgtgacgcctttccaagttgcaccagaaaagagtggctttgcagtgtcaggtcaaatttcacaagtggttcaactcttagatttctttggtgaaccaagtgaaattgatcaaaaagacatgatgaagctttcacggccattgattgaatacatcgaaacattgacgtatcaagtgacggcggttgctttgaatcggggcgttcaactccaatttacagcgcaagccaacgaagactaatcagcgaaaggtcgcggcaattttgccgtggccttttttagtaccgtgattaaaaacggtacgggactgacatttatgggtttagtagtacagatgttcgtgtataatggatagtaggatttaaggttgaaggagattttcatggccactaaaagtaaaaaaagaaaaccagcagcacgcaaaaagaaaaaacaacaaactgatttcacagttaacatcatcgggtttatttttattttaattagtttatttgcgggtttaaatctgggctttatcggcgcgctttgcgctaacgtattccgtctgtttgttggcgatacgttcattattagtgctattttattcgcccttttgggggtctatttgttgatttatggcaagcagccacccttatggcaccaaaagacgcttggatttgcaatcgcgtatctcgggattttaatttggttgtcagcattcgtcttgcaccatcaagcggtcaataaccatttcttggccgccacatggcagcttttattggaagacttccagaagatggccgttacgacggaagttggcgggggcttaattggcgccgcgttgtatggtgttttccacttcttgttcgcgcagatggggacttatctgattgccgtcttaattgtgattatcggcgtttttgttttcttagatattccattcagcgtcgttgttcagagtacacaacggtttgtacatgggctctttaaagttggcggctacacgaaatcagggttccaaaaggtctctgaaaaaggtaaagcgcaagtcagtgctttaaaagaacagacgcaaaaagctgttcaaaatgcaactgaacaagcagaagagacgtcagagactaaagagcaagtggtcgcaacggacggtccagaaaatgcaccgaagcaaaaattggaaccttttaaaataaacggtcccaaggatctaccaaaaccaattgcgacgcaagcagaaccaactgcacccgaaccggtggctgacgaagatgagcatgtcccagatgtggcagaactcgcaccactgaacgagacggatgatgattacgaattgccaacaccagcattattaacacaaattccggcgtctgatcagagtgcggaatataaagccatcgagaagaatcaacaggtcttgaaacaaacatttgattcgtttggtgttgatgtgacggttaagagtgctagtctgggaccagccgtaacgaagtacgagattcaaccggcagttggggtgaaggtctctaaaattgttaacttagcggatgatttggcgcttgcattagcggcgaaggatattcggattgaagcaccaattccaggtaaaccgtatgtcgggattgaagtgccgaacacgaccgtttcgaccgtttcctttagagaaatgattgaacaagaacccccacatccaggcaaaccactcgctgtgccgttaggtaaagatatttcgggtaaggtcattatgtcggatttagcaaagatgccgcatttattaatcgccggttcaaccgggagtgggaagtccgttgcaattaacgggattatcacaagtattttaatgagtgccaaaccacacgaagttaaattgatgttaatcgacccgaagatggtcgaattaaacgtctataatggggtgccacatctattgattcctgtcgtgacgaatgccaaaaaggcggctaacgctttgaacaaggttgtaaaagaaatggaacgacgttatcaattatttgccgatacaggtcagcggaacatgattgaatataatcagtatattcaaggccacaatgaagacggcgaaattaaaggtgcaccactgccttatatcgttgtcatcgtagacgaattatctgatttgatgatggttgccagcaacgaagtcgaaagtgcgattattcgtttggcacaaatggctcgggcggcggggattcacatgattgtcgctacccaacgcccatctgtcgatgttattactgggttgattaaggccaatattccatcgcggattgcgtttgctgtatccagtgggattgattcacggaccatcttagatggcagtggcgcggaaaaactgcttggccgtggtgatatgctttacatgccaatcgggatgagcaaaccattacgggtgcaaggcgccttcatttcgagtcaggatgtcgaaagtatcgtgtcgtttattaaagcacaacaaacggcggaatacgacgaagaaatgattccaaccactgagcaggaaaagcaatcaactgaagaaccagaagatgaatattatcaagaggcagtcgaattggtcgttaaacaacaaaccgctagcgtatcaatgctccaacgccgttttagagtcggctataaccgggctgcacgcttggttgatgagatggaaagccgtggtgtgattggaccatcagaaggtagtaagccacgcaaggtgttattacaaaacgtaccagaagaaccaacagaacaatagcgtgtgacataagtcgaatatcgcctaaaatggcgaataagcgcgtcagcgattgattgacattcaggattaactgaaaggcgctggctgatggaactcggttaaactattaaatgaaaaaggccgcgacaaaaaatacttttgtaacaaaggattaatgctggctatattaatcaatcgattgcaggcgttttgtataccgaaattaatcaagcacagttattgcaactccaacaattccaaggaacggatatggctttaatcgaggcttaagaatctgagctttattttcattgcggtcactggaatgtggcagtataggaaagggtgatgacgatgcaatttggtgaacgattaaagcaacaacgagaacaacgcgggttaacccaggaaatagtcgcgcaggaatttcatgtttcacgcgcaacgattgccaattgggagcatgagcggagttatccagatattaactgtttaattgccatcagcgactactatcagatttcgctcgatgttctattaaaagaagatagtggcatgacagaagcgatgcaacggaaactcgagttgcaaaagctaaagcccttctattggggttcgttattaattgatggctttattttagtgattttaatgggtcgcttttatcaattaccattcctgaaaactgatccgtttttagtaatggtgattttgctaatcgaagtagctaatctctacatgatgttgacggttcgtaaccgtcaacaacagttaggaattcaagatatatcacagaagtcgattatgatgtatgtattcggtggattaattgttctgttaattgttggattggcactactctcaagtcaatggggcgcaattggcgttattagtgggattgtcatgcgggttcgacaacgccgctcgaagaatagctaaataagtgcctcaaatacattagttgtgcctgcgttttggagtctgttagtgacattaataggggtaattagcttggtcaaacgaaataaaaaagcttaattaaagaaaaaagcgcggtagatttgtaaaaatctaccgcgcttttttggattaagcaaacattttcttagttgcgcgcatcaatgtcttgatgtcacgatcataacgtggtgtatcgactaacttggccattggaatgccagcgaagtgataagctgcaatttcgccagaacgaacagcactttgttcagtgaaaatcatctgataaggttgttcaacgaattcaccagtgaaggctaagttggttgaatgttcggggatgacttctggacggtcagttttggcacgattattaaagagtgctgaagcatatggcatatagacaggaatgttattgatgacactgtccataatttcagcttctttttcacgaatattgattgggccaggatcaacttttgatagttggccaattaattcttgaagcatttccttacccgtcatttcgatgtaaggtttatccacaaattcaccgttacgacgtgggtagaggaagtaaccccagataaccgcttcgtttggtttttgcgttgtgaagtgtggttgatggtgaacaacaatcgacatattcacatctttttgaccaagtggtgtgattggtttcgttgataggaacgaattcaaagcattcccaggaatttgcgttgtaatccgttcgatttcgtttaacaaaatatgattcttagtcgttaaagtgaagctgacccactcactggcattgcggtcagcgaagaatttatcgggattgccaagattatagaatttagaagcgacttgtttccacagaccggcagcagcaccataatccatgttttcagctgctggtgtattataatcgccaagtgttgcggaatcggtaattgacccgtttgtgaagatgaccgctgtgtcgtcgtccaccgtaacgtgttcaacttcatctgtctcagtattagtcattgtcataccagtaaccgtaatttcatcggtcatctgagtctctttaaagtctaagtcagtaatccgtcgattgaggataatgtgacaaccttgcgcttttaagtagttaatcagcggcagcatgatactttcgtactgattgtaacgtgtccggttaacaccgactaagtgttcaatctgagtgaattcataaatcatttggtgcatgtaacggcgtaattcttgtgcggaactttgggttctgaaagcaaaggtggtttcccacatgtaccagaagtttgtttggaacatatgtggatcgtccttgaagtattcggcaattgaaacgttgtctaatttttcttcttcagaatcgggcatcataatcaatttggtcattaataaccgatccttattattaaagccgagatgaccagcatccaaaatacctttactaccttctaataaacgtgctttgtcgaatgtgcggtgttgagcatcgaatgaacgggtatcttcttcagccgtcatattgggttcagttgctgaaggaatccgacctagaagatccattaaatcgacataagtccgatagttaagcatccgcccaccacgtgcaacgtagcccttagtattttcgagaggatggtttttattccaatattcatcggttgtttcggaaactggtgccccatcgtttgaaccatggtcatctaatgaatagaatgtaatcgcatcgccagaccaaccgccttcttgaattaaatagactgctgcggccatgttagaaaggccagcgccaatcataattgcttttttcttaatcatatgaaaaacctcctagattcagtttagaaatgacgagtgactaacggctttcgaatttttcgtaatccacagaatcgtctctaaaaagttccattttcttagctaataaacaagcaccggttgctgtaacacctacaaaaataaggctgcctaatagaaattttttcatgtttctcgcttccttccattaactacttttgatatctatattataccacgaattcctaaaataggaagataaaacccttacataggaattgtcagtggtcatgatacgattattgatgggattaggccgctaaaaatcagaatagttaagtttagtttaaggctcttattagtcaggcataattcctagggaagcactaacggatttaaaaaaagtgataggcccccaaataatggttgacctcaagtcagcttgaggttgtaaagtagtcttattgattagaaaaaggagacttttaaatgcaaaaattatctgccttaacagccccaatgaccttaagcaacggtgttaccattccaggattagggtatgggacatatcaaacaccaaatgaagaaacaaaaaaagcggtcttagaagctttatcagttggctatcggcatattgatacagctgccgtttacggcaacgaacaaggtgttggtgccgctttgaaagaaagtgatatcgtgcgtgaagacatctttgtgacaagtaagctatggaatacagaacggggctatgatgctacgaaagctgcctttgcacaaacaattgcaacgttaggtgttgactattgagatttatatttaattcattggccagctaacactaaacaatttgaagccaaagatgctgaattaaatgctgaaacttggcgtgcaatggaagatctatataacgaagggaagatccgtgcaattggtgtgtcgaactttatgccccatcatttagatgcactcatgaaaaccgccgttatcaaaccaatggttgatcaaatcgaagtccatccgggctgaagcagaagctgtgcgttataatcaagcgcatgacatcttagtcgaagcttgggcaccacttggtgaagccagtgcgctttcgaatgaaacgattgcaacaattgcgacgaagcacggcaaaacggcagcgcaagtttgccttcgttgggggattcaacaaggtgtgttaccattacctaaatcaactcatcaagaacgaatggcgcaaaataccgatatcttcgattttgaattaacagatagtgaaatgacccaaattagtgctttggaaaacttaggcggtcaatgcatggtgccagatgacgttgatttttaagcaagtataaggaaggttaatatggcattatcaattggcgtagtcgcccaacaatatgatttgagtgttccgacactacggtattatgaagaacaaggattattaccgtttattaaacgcagtccggctggtcggcgtgaattccggcaagctgatttagactgtttatgtgatattgaatgtttgaaaaaaagggtatgcagttaaaagatattaagcaatacatcgattggcgaactgcaggtgatgaaactttggaccaacgcttggcgttgattcaacaacggcggcaaatgttggctaacgagattgaatcactgcaagcagaattgacgaagctagatcataaagaatggtattacacaaaggcacttgaagccggaacagaatccatttttacagctgactgtgatacagaatatgaacgtgcgcatcaataatcgaaaaaagaggcaacctgataggttgcctctttttgtgtgtttaaacggttaatgttttttgcataatcagatcacgttgtgcgtcgcttccgagttggaagatgtgatcaccaacttggctgaagccgaggtttttgtaaaagttaagtgcagcagtgttgtgttcccacacgccgagccatacgttagttttatggaattgttgcgccacggctagtgcatggttaattagttgtgatcccaaaccaagtcgcttaaaggactgtcgaatatagatacgttcaatctccagtgaatccggggcagctttttcagtttgtgcgccatcaatgttgagctttaaataaccagcgacttcgccatcttgataaataaaatagaagaacgaatcgggattctcgagctcgctagttaatcggtctgtattataagcttcttctaagtagttagcgagatcttctgctgcattttcagcgccaaaagttgctgtgaaagtttcacggctgatggattgtaagtcaggtagttggtttaatgtgacagcttgaattggcattgtgatgcctcctttgttgtaatagtgtcggacgtgtccctttttgacaaaatcccagtttgcggcaacgttggcactaactttgtttaggagtgcttcaagattatgggcctcgtcggtcgtcagtccagtcagtgccatttgatttgaataatcgttttcagctttgatggcgggatagacggctcgaccggcctcggtgagatagagatgtttgatcttacgattggttttgtcagggtgtcgttcaactaaaccatgcttaattaattgttgaacggcgcgcgtgactgttgcgcggtcgacttttaataattcacctagacgttcttgaatgatcccaggctgttctgcaatgcggactaagtaaaggtattgcccgcgggttaagtcatattgttggaattcaatattagcaatggattccaacgcgcgggctataaccccgattgggcggagaatttcagtcatgatggcatacctcatttcgataaaaatagtataaaatatttttgttgcatttacaacaaaaaataaagcttcgattcgttaagtacgccaaaaataagaatataattaattctcgatgtggaatatgcgctttcattttaaaattgataaaatttcaaataaatatatttaataatgtgaacctgatgtgttattgtattggttgcagagcaattgattgtccgtgatgaagttggcgtctattaaaatcgaacaacaataaggactgggtgaagactacatggctttttcagattacataacaaggatactcatctacacaattgtgtcgtatccaatcgtcgggggattatctttcattgtttctagtctttattactggttatttttagaacgcaaagatatgccacgttacttagaaaaagggacgccattcattactattttagtgcctgcacataatgaagaagcttcgattgaatcgacaattgaacaccttgaagagtgaatgaattatccaaccaatcagtatgaagtgattgtggtcaacgatggttcaaccgatcaaacaggtgctattttgaatcggttgcagattcggtatggtgagaagcgcttacgtgtgattacgatcattaataatcgtgggaaagccgctgggtttaatattgcactcggattttcaaaaggccaatttttattatcgaatgatgccgattctaagccggaagtggatgcattgtggaaatacatgcactatttcgaacgagaaggtggcgatcgattaggggccattactggcaatatgttattaatcaacaaaacatcgttggtagctgaagcacaacaaaatgaattgaactcgatcatcggactgattaaacgttcgcagctttcatacggtggtctatttgcattttctggtgctaataccatgtatcgtaaggtggcgatcttagatgttgggggttggcaagcggaacaaccaactgaggatatcgctatttcttgggatatgcaggtgcatggttggcaagcgtatttcgcaccacatattcgcttttttatggatgtgcctgaaacactgcctgagttggtcaaacaacggagacggtggactgccggtgggattcatgtgttgttaacgaaatcgatggatgtctttagacacccgattaaacatttggcaatggtacccattattgttgattacagtttaagtgttatttggtcgctatttttctggttaagtatgattgcgtttgttggtgttcaggtgttgtgcttggtccaaggggattggtcacgtctaattaccaatttctgctttgcagcgatttttatttcaattgagattgtggtgggcttaattcagttgattatggcgtcttactttaatgaccgtggacgatcattaaagtatattgcgtttgcgccatggtatatcctaatctattggatggtgaatactttcaccgtggcggttgaaatcggaccaacgattattcagattcttaaaggcgaggatgctggcgtttggaagtcaccaaaacgttcggtagaggtcgtcgctaagacaaaagaggagggcaatcaagatgactaaaccagactatatcacgtatcaagtgagtgaggcatcgttgacgaatgattggttttttactaagaaaaagacgggcaaaaaaatctggcaggggattctgattgccattggatggttaatgtgtctggtaccgatgaccattacgggggtcttatatactgtcaaaagtgttccgctaccagttgacttaatggcctttagaaggatattattacagactaattattactttttattatacgttgccgtatttgcagtcttctttttagggctttttctattgaataaattacgaaaatatcgtttgaaaaaaggtttgctgcggatgtatgatccgacgcgattgagacagcgcatcgatctagcagaggatatgtacttacaaaagtatggtccattagacatgcggcacgaacaaccacagattatcattccagattacgcggatgtgggcacctatgaattacgacaaagatttgattattttgaggaggaagaagatgctttctaaaaaagatcaagcaattgtcgatgacatgattgttcgtgagcgaaatatgaaaaaccgccaacgcgtgattggggttattatgcataagcgacggttgtttaagcaacgtttagtgatgtacgctgctattttaacaacggctggtttttgggtgttatacacttcttttgcacgatacggtaatttatccgtcatcaatattattcaagtgaatgttttgatgaccgtgattttactattcttcaatttttatatttggcagaaattggtgcgctataatccaatgcaattgtttatcaaacactataataaccgcttgcgtgtccagtatgcaggggcattgttggcgtctaagcggtggttacaattttattatcacaagcgggaaatttcgcgaatgattccacagattttgtattttttacatacaaaaccacagtttacatcgatcgatgaagtaatcgcgtatattgataaacaaaacgctaatccgcatattcatcaaaatgatttgcgcaaatttcagaagttcgttaatcaaacaaatgaaatgatgctcagtacttcggatgaaaatgggcaaccttcaagccgccaaatgcggtttatcgtgttggatgatgcaccgaatatttggtattttgggacagcaccggatacccctaagattgaagaactcgatcgtggtttagcggcaattcacacaatgccaactagcgaaggaatgacgattgctagcagccggttgcgtgtttatcgcgcgcagtacaagttagatgaattagctgattattacaacgcccaagtccctgggtttatggatagtttatcagcagaagatcgtgaacgggaaattatctacgcaattgaactgaaaagtgcgcgcttggatagttggacgcagcatgaagaagtgacttttataaatgactaataaaaagatgataaggaaataataagaaagggttctctgaaatcggcttctaaagtcgtaaaaggcgcttacaaagcctatattttatgatttgttaagtaagcataatgtttatgtaatgttaatgtaacattcgccctatatacttagtctcagagttcgggcttaactaataggagaaaataaaccatgtcatttaaaaaaacgattacgactacaattgctcttggattattaacagcttcagttctttcaacaaacgtagtatctgctgcaacttcaagtgaagcacaagaagcgattactgctaataagaacgcaacaaacgatttgctcaaacaaatcgaatcagctaatacagaagtgattgggttggatcaaaagatttcaacaaacgcttcaaaaattgctgatcaagaagcagcaattactaaagcaaataatcaaatcgaatctctttcaggtcaaattacggatgctcaaaaagaagtttctaaacgaacagtcgtattgaagaaacaattagtgaccttacaagaaaagagtggggatgctgtcagcgggaacgtatatgttgacttccttttaaactcaaatgacctttcagatttagtttcgcgttcattcacaattaataaattaaaccaagcaagtaaagaagctttagatgatgttaacagcgctaaggcaaaattaagcggcttgaagacagaacaagaaaatactaaagcaagtttagttgctactaagactgatttagaaaaacaaaaagcaaacttagaatcattgaagagtgaagctgatcaaaaacaaacagctttatcacaaaaaatcaatgataacaaagacgaattaacagctttacaagcagacttcgacaaagcaagtactgaagaagcagacgctgctgctaaaaaggctgcagacgatgccaacaatgctaaaaaagacacacctcaacctacatcaattgacacgccatcagataataagggtggcacatctgttttcggtggcagcggaaaagttgctggtaattcagctgggaattcatatgcatggggtcaatgtacatggtatgttaagtcagtagcaccttgggctggcaataactgggggaatggtgctcaatggggtgcttcagccgcagcagctggcttcacagttaaccatataccagcagcaggcgcaatcgttagctttgctggtggccaaatggtaggttcttgggccgcagatgggacatatggtcacgttgcttacgttcaatcatacgatgccgcagctgggacaattaccatcactcaaggtgggatgggcttcagcaaccctgctggtcctaacacccaaacaatttcaaatgccggggcatttacttatatccataactagacattaatgattgaaggcccgcatcctagatgcgggtctttttttatgaaataaaatcaattttataaacaaaatataaatcaaatctagaaggtcatctgagtaactctagtcataaaaaggtatttattgatgtggattttggtaaattataaatgaatcactgccgaaaatcttgattgtcgtagaagtttttaaaaaatatttactttttatgaaattaagactataatgacttgcacaaaagataatagcgcgataaactagataataataattataatattgcttaattataagctaatttattattagtaaatgttggttttacaaatgatggcaacagagtttagtaggagaatataaaatgactgaagataaagcaaagaaagattaacagatttgttgattgggtcaatgcaatcaaaacgattcaatttaaactcaatcaaattggtgaagaatatggtgttagttttgacagccatttaatcttaaagttaatcgaagaaaagcaagcgattacgccaggacaactcgctaaggaaattggtggtggcgctcctaaaacgtcacgcaagatcaacactctttatcggaaaggtttgataaccaaagaatttgggacaccagatgatcagcgacgggtatcattggcggttaccgacaaagggagagaggtattagcacttgtcggtcaggcatatgaagattggtacgcaaaccatattgatgaaattctagagataaatggaaagttaaagtattagccatcacaaaaaaggcataaccacttagttggttatgctttttttgtgtgcatctaatagttttgttcgttcattcgttaaaggggtacattaaattcagagtttggtatactgagggaatcaacaagtatctaattttgttgcggataaggagtaagatgatgcatttggaaaaacgaacaacctttttattaactggctgcttgcttttgttatcagctgctttgtggcttattttcggtcctgctaagacggttactgaacaggcaatcacgcaatctagacaggtaatttatgcgcgatttacactccctcatctaaaacgggatttgggttactatcaagggttaacgccggcttcttttggacagtatgcaaaggcaacccaatctggaacttacttggtgccagatttagaccaggcgcagatgttgaaaaaaacgccggcaggttacaaagcatatacagcagaaatgatgacacctcaagggggagcagttacgccggactatgtgatcgtttcggcttatgaccatcaacggcaaggcaactcaattctgtccattatggataagcggactggccgacatttgaagaatattattttaaagggccgaccacacgttggtggaattacttatgatcctgaacatgatctcttatgggtttgtggccgtaagaaggcacgtgcatagctatttgcaattaagttaacaactattcgccagtaccctgcagatcagccgcaaaagccgattcaatactaatattcaacgttgttgaagtcgatcacccgggcttcacttgttagctatcacgatggggcattatgggttggctatttcaatattttcggggatagtaacgtccagtcgtttcaggtttcagcggtcattaaagggcgcgaaaaagctggtgttaaattgacggcgcggaatatccgcagtaatgaacttaaaagtgaacaacgttggcaagcagtggataagattcaagggctaacttttagtgatacgcgggcttatttttcgcagtcctacgggttagacgattcacggatttacgtttttgcaacgactgggcggccccaacaatttacgccagaaaaggtgctacttaagattcggatgccagctcatttagagcagattacgttggatggcaatcggttatatgcggtttttgaatctggtgccaaagcgtatgcattaaatgctaaaacgcggattggtcgggttgtatcgtttgatattgatactctggtaaaggaggcaaagcaaaatgatgatgcaaaagctcagtaagcgcacatggggattaatccttgcgagtttgatctttgtgttaacgcttttgaatacgaatcaaccactgttgcaattatttaacctagactttgcgcagttagccgcacaaccgtggtggttacgtcttctaagctttgcttattacttggtgttagtcattgcgctaggatggtggttgacgcgttttgatggtttatggctggcacaagaaggttcatttgggcttcctagttggcgcaatattcgtggggctatcggtgcaattgtactcctttgtggcattccaatcgttggagcccttttaatgtatcaggtactgcttaaatcacttgaagtcggtctaataaatgattacgcagccttgatttatcagaaccaggtctggccgacattagcatggttcttttgttgtcagatattattcattagtttgtacatgatggtgattattacgactggtcagcttgtgaatacaatcttacaaagtctacgggtatccggttggttcttgcgcttgttaacggtagtcgttgtcagttttttaatatttggcacgttatcgtggcttgcggttccaagtcaagaactgctcgattggggcagtttattggccttatatcattttcaaaagcaccgtaatttttggacaagtgtcgcgattgttctcattagtagcatgatttatctgatgatttcattattaccaattttaacgtaacaattcgggaggaacttatatgcgccgtttaacatcatttttaagggctaattatcggctctttagacaacattggagtgtttatttattactgctcgtcatgacgaatttaattattggcagcttggtggcaccgctgtttacgtggcttgtagaacggttggtggcactcaatggcgtgacgtatttaacctacaccaatctggtgccggtgatgatgcgtcatccgcttttactgattagcttactaatcattctggtcttgatttgcgcggcagtttatctgcaaatgacgttcttgttgcgcagtatgcgccatattcaaaagcaaacacaagaaacatactggatgatttttaaggaaacagtccggggattagtcgctttacggccaaccacgatgttggttggtttactgtatttcttattaatcttaccctttggacaggtcctctttaaatcagcgttgttatccaaggtgactgttccagattttattattcaggatatgtggtcatcacccaaaatttgggtccccattatcttggtctacgcgagtgcattagtcctttcaattcgcttaatcacgtttttaccagaaacgattgcacatccaaaggcgcagctaagaaccacgctcaaacactgttggcaagctacccaatatcaggcttggcgtatttttctaaaaggctttgtattaacaacgtcggtagcaattgttggagtgggcttccgcttaatcttgtttgctagtcaacggtattacgaccaacacttgccacaccaggctttatttttagccattttgaatctgtttattttagaaatcgtcagtcagattttactcgcattaacggtggtactagtcttacagattgtattgaaccaatatggtgaagttcccgcaatggcgacggttgtgcgccaatctaaggtgaaaaaacggactaatttgacgattctccgccaaattggcacaatcggtttaattgttatcgtggctggtggggtagcattgtacaattatgtctatttagagggaatgttggacgatcaaccggccttgatttcgcatcgcggggtagatgatggtaatggtgtgcaaaatacgattccagcacttgaaaaaacggcgcaggaagagccagattatgttgaaatggatgtgcatgaaaccaaggatcaacaatttgtcgtgatgcatgacgataatttaaaacacttggcgggtgtcgatcgcggcgtccatgacatgacacttgctgaattaacggcattgactgtccgtgaaaatggtcattctgcaaaggttgctagttttgatcaatatctagcagcagccgaaaagcaccatcaaaaactactcgttgaaattaagacaacgaatgaagacagtccacagatggtgcaacactttatcgataaatacgaaaaacgacttttgaagaatcataaccggattcattcattaagttatctgattgtggcggaaattaaacaaaaagcaccccaactatttgttagttttattctgccgtataacattacattcccccaaacgccggctaatggctatacgatggaagcgacgacgctcgactcagattttgtgggtcaagcacacggcaaagggcagacagtatatgcttggacggtgaatgatgaggatgtgatgcaacgcatgttatttacaagcgttgacggcattattaccgatcaattatcgacgcttaaagaagtggtcaaggaaaataatgaccatcctagttatgcgacgcgtttatcaatttattcaagtcaattagccggtttcaatggtgacgtagaaaattaagccaaaaaggccttaggcaaaatcagtttgcccaaaaggtaaataggtatgggctaaattccccagttgtagatcctctttatccttaccaaaaggtttgataatacgttttagccgaccagctttgactgcttcagtcatcgtttcttcggattttaaaaaccacttgcggcaataaggacaagcggcgttgataaattcaattgatgttaatggtgcatctggctgaccaattgtaataccgccggtggttgtcacattctcgcttttaatcacactaatatccatggaagaccctcctttaagatactgccagtataacaaatttggtataaaaaaagggctagatcaacttgatctagcccttttttttactaatcctcagaagagaaccggtttattatctactctattttggttggttgaccataatatcgtcaatcaaaccgtaatcttttgcttcttgcgctgtcatgtagttatcacgatcagtgtcagcttgtaatttttcgaaggtttggcctgagttgtctgccaaaatttggtttaaacgtttccgagtcttcaaaatttcgcgcgctgcgatttcaatttcagtttgttggccttgtgcaccacctaaaggttggtgaatcaagacagttgagttaggcaatgcaaaacgtttgccttttgtcccagctgaaagtaaaacactggccatagaagcagccatccccattgcaattgtttggacatcagacttgatgaagttcatcgtatccatgatggctaaccctgcggtcacagaaccaccaggtgagttaatgtagattgagatgtccttatctgaatcttgcgcgtccaagaataataattgcgcaatgattgtgttagccatttggtcgttcacttcaccagataacatgataatccggtcttttagtaaacgagagtaaatatcgtaagcacgttcgccacgagatgtttgttcgataactgtcggtactaacattgaattgcctccttatataagccagagtagaatcactctgtagtctatacattgaattttacagcaaaggtcaattttggtcaaatagaaagcctcttttcagaaagattatggtcattttgtgttcgaactgaaaatatggtatacttaggaaagttaatcagcacttatcactgtagtatcaagtattatttggagactttaatcaactggagtaaccatggagttacaagtagtgtaaagaggcggcttacgctgtttaaacgagaagatatttagaaacacaagaatttagacataattgaattaacccaaaaataaaagcgacgtgaatcacacgtcatctccactagccattcgatgctagtgtgcgtagccaattagtgactggctacctgacattatgtaagaatttaatatgcgaaattaattagaaggccacctaggaataggtggcctttgtcaatggtttaaagattgagttgttcatgaggaggactcaatcttttttaggctatatttgtaagcgctattgtcaaaatgataatcgcgtgctattatatgaaattgaaccggttcaattctattcaataaagggagaaatgactgtgaaattcgtagataaactgtcagaaaagatgttgccgtttgtttctaaactcaataattagcggcatctaattgcaattcgggatagcttcattgtgacaatgccacttgttatggcggcctcgcttatggttttattaaatgcgctaattttctcaaacgccgctgttcaaaagattgttgatttaagcggattagctgatctagcaataattgtgaataatgggacgatgagtattttatcaattgtggtctgttataacatcggtgctaatttagcaacgcattatgttcgctctgggaaagtgaacgatcctgcatttagtgcagttcatgctggtattttaagtttggcaacaatgtttattttgatgcctgtgacgagttccgtcactttagcaaatgggaaaacggcggaagcaacaggcgttttcttgcaaagtttaacctcgtcatcaggacttgcaacagcgatgttagcggcattgattagtacggagttattcattcgttttacaaagtttgaaaaaatacgaatcaagatgccagaaggcgtgccaccagcagttgcaacctcgtttaattcattagtcccagaagtcttggttgttttgatttttgctatttttgtatttattttaaatgtgacaaccgggttgaatgtccctcaattaatcgaccttgcgattcaaacgccactaaaatcgtttgtattatctgtaccgggaacgttattcttacaattcttctcagatttcttatgggtctttgggatgcatgggtctagcattttagcgccagttcgccaagcaccattgctacaagccattcaagaaaatatggcggctttttcagcaggacatgcgattccaaatattattacagaaccttttacaaatgcgttcggcttgattggtgggggcggctgtattttaccgttagtgattgccatcttatgggcttcacggcggaaagatcaacggcaagttgctaaattagggttaacaacttgtttcttcaatattacagaacctgttatgttcgggttaccagttgttatgaacccaattttcatgattccatgtgccatcattccatcaatcaatttagtgattgcttattttgcaacaagcttaggtttgattagtaaaacggtagcggctgcaccatggattacaccgcctgttattcaatctttcttggcaactggcggtgattaccgagcagcgattttaaccatcttattaattggtttagatgtctttttattcttaccatttgtcattgcaagtaacaaagtattaactgaggaatgaggtttttgaaatgcagtatccatatcaagacgcagcgctgaccattcgtgagcgggtcacttatttactttcacgcatgagtacgcaggaaaaaattggtcaagtgaatcaacatctttatggatgggaaactttcgaagattctcagtcattaacgtttacagaaaaattcaaggcgcatgttgaatggggcggcggtgtcggtgcactttatggtttatttcgcgcagatccatggtcaaaagtgaactttgaaaatggcgttcgtgcacaggatagttggcgagttgctaataaagttcaagaatatgtcatggcgcattcacgctgggggattccagcattaattgttgaagaatgtcctcatggccatcaagggcttgaaggaatctcgtatccaactaatattggccgcggcaatatgtttaatacgcggttaatgcagcaatcatcgcatttgatggcacaagaactagcgcttaaaggcgttaacctagcgcttgtttcgacgcttgatttggtcaaagatccacgttggggccgttcagaagaatgttttggtgaagatcccattttagcggcgcgaatgagtgaagccgttgtggcgggttttcaaggggatttaattcaaagtgatgttgctttcttagaccaacctgctaaaccgcgaacgactgatgccattggtgttgtattgaaacactgtattgcgcaaggtgaagcattgggtggccataattcaggcaccgtcacaattggccaacgtgaattttcagacgtctatgaaccccttttgagtagtgtcaagaatgcggcaggtgtgatggctgcttataacgatgtggatggggtaccgtgtcatatcaatcagccgttgttgactcaagatttacgggatgtaaatgggtttcaagggattgtgatggcagatggtgttgcgcttgatcggttatcaggaatctttgaaacacaaccagaagctgcggcggcagccttaaatgcaggtgtcgatctaagtttatgggatcagacattcctaacgcttgatcaagccattgaaaatggcctagtagacgaagctgccttagataatgctgctggccgagtactagcgttgaaattcctgttgggtctgtttgaacaaccctatgtacaagccccgaatgcgcaattgacggccttacttgaaaaatctgatgcgctgaatctgcaagtggcacgtgaaagcatgacgcttgttaagaacaatgggcttttaccaatccggaatcagccgcaaaagattgcggtgattggccccaatgctgatgaattatataatctcttgggggattatacagcagcacaaagttcagcgcgtcaagcgcaaacaatttatcaagcgattcaagaaatgtttcccgagtcggaagtcgtgtatgcattaggctgtgaggtgcgtaattcaattcatcaagaagaggcaattgccaaagtagttgagcttgcgcgcgatgccgatttaatcatccctgtattaggtggttccagtgcacgtaattttgatatggccttcctaagtaacggggcagtgagttccaaaggcatcaacatggattctggtgaaaatgttgatgtcgcatcacttagtctggggggccaacaagaagtgctgctcaagcaattgaaagcactaggcaagccaattgcatgtatcatggtgcaaggccggccatacgatttaacactggtaaatgaacttgcagatgctgtattgattgcttggtttcctggtcaacaaggtggtcgcgcaattgctgaaactttagtgggacttaataatccaagtggtaagttgagtgtgtcttacccgcgcaatacccaacaactaccggtttactactatcaacgcgatgctgctaaacaagatgattactatgatgaggttggccaaccgttatatccatttggttacggacttagttacgaccaatttgattatcgacaattagcggttaagcaaatggttgacaaactagttgtaactgttaaagtaaaaaataacggacagtttgtaggccaagaaagtagtttattatttgtcaaattaactggtggagcagttattcaacgaacgaagctgttaaaagctttccaaaagaatgccctccaaccaggtgaagaaaagagcattactttcgaactacctgctgctgattttaattacatggatattgataatcaggtgaaacgtgcgcaagcagcgactattatggttgctgatttagcggagaaaatcactttatcgatataagcggggaataagaatgtcatctgttagagaagtcgctgaattggccggagtctcagtcggaactgtttcacggtatctgaatgggcaacagcttaaagcagctaatcaagccaagattgcagcggccattgagcaactcgattacaaacaaaatattatcgctaaaggattgaagaacaatcaaagtttttcaattggtttattgatgaatagtatttcaagtcgatttggcgcggaagttgtttctggaatagaacaacgcgttgagcaacaagggtatagtttattattgagtggttttagtgaccaaccagcgttaattgatcaaaaaattgattatttaatggcgcattcgattgatggtttaattgctttcttagcaggtgaagaatggcaaggaatggaacgactagcggcacttgatattccggttgtgacgattaataacccaaatcagctacgcaatgttgattcgattttattagatgatcgcgcaagtgtggcacaagtgatgcaacaaattattgatctcggacaccagaatattgggatgattgccgctaatcaggatgattatgttgcccgtgaacgactggcaggtgctaaacagacgatggcagcttatccagacagacagttacatgtttttgaaggtgactattctcggactagcgggtaccgcggtgcccaagcattattagccgaaggtattacagctttatttgtcagcaatgataatatggcctttggtgcgctcacttatttatcagaaaatggtattcggattggccaagatttactatttggtcactatgattatgccgatgaacatcaatttggacagttgccaatcctatcgattcaaccgccaacagaagcgattggattggcagctgctaagttgttattagatcggctccaaaataagactcagtcagatggtcaaacgattttaatgcatcatgaaatcaatggtctaaactgaatcatcgaaaagggcgagtagaataatctacttgtcttttttgagtttaatccttaggttattaatttacccatccccgataatggggtacacttgtggtgtacattattttgcatgattattgaggagggcttggcgtggcacaaaaaatgattttggatttagatactgggattgatgatgcgttagcaattgcttatgcattgggatcatcagaagtcgatttaatcgggattacctcagaatacggcaacgttttgactgaacgaagcgttgtgaatagtcaacaaattttacatttattaggtcatccagacattccagtttatttaggggctgggcattcgacgacgacgcatgattttagcgtcttaccaattagtgcggaaattcatggtcaagacggcgttggtgagattcatctgacagagccccatccggaaatggcaactgaatcagccgttgattttatattacgtgcttgtcaggcgtatggggctgacttgagcatcgtggcaactggcccgatgacgaatttagcgttagcgattcaaaaagatttaccaactttgaagaaagttggtcaaatcgtgattatgggtggcgccttaacagtttgtggtaatgtgtctccatttgctgaagctaatatcagtcaagaccctgaagcggcggacttactctttaagagtggtttgccggtgacgatggtgggccttgatgtcacgttgcgcacactttttacacgcaccgatacggcagaatggcgcgcactcggtacaccagcagcccaagcttatgccgatatggttgattactatatcaaagcctatgaagtcacttctccccatttacacggctgtgccttacatgatcccttagcagtcgctgttgcaatcgatcctagcttagtcacgactttcccattgaacttgaagactgagatagaaggcccgtcacgtggacgaacaattggggataatgcccgcctagatgatccagcaacgcggacggcggtttgtgtacaagttgatacgccgcgtttcttaactgaatttaaatcaagaattggacaattattagcgcagtagaatgagccatatagaatttcaaaaaagagctacgacaaaagtcaattttttgtcgtggctctttttttattgtacacaattagcataaaaaaaataatatttttgagcaattgaaaccctttcaagatgtggataaatgcgattatttcacaatgttaatatagttattataagcatattaatatgagaaccataattggaagcgatacattgaggacaaatgaaaggggtgcaatgaaatggaaaagaatagtaggatgaaccaaaagcatttattgcgacgaagtttgtatgtgtgtagtgggactcttttattactgaatagcggcgcggggatagcaagcgtggttgttatgaatcaaaatcgagtgcaagcgagcgaagtagcgcctagagctggcttagccgatatctcgattttagccaacgcgagtctaacatcggtgacaggaacagatatgacatcgaacgcgcaaggcaattatgatttagcattgaagtattctgggaccgggctggcatcagttggcgtcgcggataagaaggtcttggtttatgccttacctgctgagttacaaggaaaagtggttggtggtgcaactgttgatattgacgctaatctattaccaattacaccaggcgatattccgggggttagtttactttttggtgcgttagggacggcgattgacggggttgataaacttgtagcaatcccagccgttaaggcagcctttgatagtttaagcactattcagaacctaggtgcctaccaagaaacgttaccagcgactgtgtcaccagatggtaaaaccatctcagttgacttcacacagggctttggcaagtacgtccatcaagcttatgtggcactatttgatacattacgggatacgattgccgcgattgatgttaagaacccaatcgcagcgattccggttaaattacttcaagaagcgagtgctgatttatttgcgatcattgatgcaattgccgatgggacgtccgatattttagataacgccttaaacgccaacctcttaggttccatgaatggcaccttgcacaccacggttagtgatccaggggttgccagtgcgactgttaaagctggtgccatcaataatgcattgatttcagccgatgttttaacggcaactgagcaagaaggcgaagctgttacacttaattttccaacgacggcggttaatcccattgaaaattatgatgttgctgccccagtcattacgcaaccagtggccggtcaaacacaggtcgccggtcaagttaccttgacgcaaccaattccggatgggacaacatttgaagcggtggtcacgttaccagatggtagcaccaaaaacgtaccgcttgcagctgacggcaccttcgttgtggatactggtagtttagtcgacggccaaactatttcagcaaaagtggttgcgactaatggaacttacacgaaagacagtccaatcacaaccgcaacggtgacagctgcaccgattgaaaatccaattgctgattataacgtcgcgacaccaagcgttgccccgttaacggcaggtgatccggaaatcacagggcaagtcacactgaaccaaccgattccgctcggaacgacatttgaagcggtggcaactttaccagatggctcgcaattaacagggactgtcgaaagtgatgggacattcaaaagtgctggtgttgatcagttagctgccgggcaaacggtaactaacggttaaagtcgtcgcaactaacggttcgtataccaaagacagtgctggcgtacaactcaacgttgaagcggcaccagttgaagatccattagcaaattatcaaatggcaacgccaacgattgatcaagcgtgtgatggcgatactaatatcacagagcaagttacactcagtcaaccaattccagccggcaccacatttgaagcaattgcagtcttacctggtggccgccaagtcaccggtgcagtcaatgcagatggcagtttcacagtggcaaccggcgacccattagttgctggaacacaagtggcagttcatatcaaagcggtcaacggtaccttctctaaagaaagtacaccagcaacaatgacagttgcagatgccttaccaaccaacccaattgaaaactatgatgtgtcggcaccacttgtcacaccagcagtggaaggcgataagagcgttaaggggcacgtgaacttggtaacgccaattccggccaacacaacgttcaaggcattggttacttatgaagatgggacaactgctgaagtagcggttcctgaaaccggtgattttgaagtgccaacccggactttggtggctgatgaaaaagttgcagtaaaagtcattgcccaaaatgggatgaatcaaaaagaaagtccaacgactgaaatcacaattagcaaggcagttgcaactgatccactagatggttataccgtaccgaaaccaagtgttgatccagtaacaagtgcggatacaagtgtgactgggcaaattaccctcaataatccaccagtcggaacaacttttatcgccaacgttaaaatggcggatggttcgattaagaaggcaaatgtcatgccagatggcacctttacagtcgcaactggcgcattagaagccaatgcggtattagaagttaccattaccgcccaaaatagtggttatgaaaaagtgagtgatccaacgaccgttacggtcagcagagccgatccacttgaaaattatgtggttgctaaaccgagtgttgatccaattaaagaaggcgatcaagttgtcactggtaacgtgactctcaataaaccagtaccagatggcaccacttttgaagcggtggtcactttaccaaatggtgatcagattacagcaactgttgatgatcaagggcagttcacagtaccagtggctgggattaaagaaggcgacaagttaacgatcaaagtcgttgcgcataacgacggttttgataaggatagtgatccagtgaatgtaaccgttgacaaggctgtgccaacgaatccgttagaaggttatggcgttgcacaaccagttgttgacccagtgaaggcgggcgatacagcggttaccgggaaagtgaccttggaagaaccgattcctgctgggacaacttttgaagcggaagtgactttaccagatggttcaatgaagaccgggatgctcaacccagatggtacctttaccgttgatacgggcacattggcagccggggatgaattaatcgtccacgtgattgcccataatggtgcaaatcaaaaagaaagtaatcctatccatgtgattgttgcagccgatacaaccacgaatccaattgaaaactatacggtgaacgcacccgttgttaatccaatgaccgacggcgaaacccaagtgactgggcaagtgaaccttgggattccaattccaaacaggacaacctttaccgcagttgttacgctagctgatggcacaacgacatcggcacccgttgcagctgacggtcaatttacagtcgcaaccaacacattagttgcagagacaacagtcggtgtgaagattggcgcaacgaacggcacatttactaaagatagttcgattgtttatcaaacggttagtccacaacttgatacgaatccgttggcaaactacacggtcaatcaaccaaccgttgaaccagtgacggccgatcaaacgagcgtgaaaggccaagtcactttagcaacgccaattccagacggaacaacgtttgaagcaaccgttaccctaccaaacggggcacagaaaacggcggcagttgatgcaaatgggaatttcgaagtggtgactgggcgcttaaccgcagatagtgacttaagtgttaaaataacagctaagaacagcacttacacgaaggatagcgaaaatgtatcagtcacagttggtgcatcaaccgttgaaaatccgcttgaaaactatgatgtcgcagaacccgttgtcgatcccgttaaggaaggcgacaagcaggccaccggtagcgtgacattgacgcaaccagtgccggacggaactagttttgaagcagtcgtgacattaccaaatggtgacaagattacagcaactgttgatgatcaagggcacttcacaatgccagttgatgggattaaagaaggcgacgagttgacggttgaagtcatcgcccataacggtgacaacgaaaaagcgagtgacccaattatcgtgacggtcgacaaagccgcagtgacgaatccaattgaggattatgacgtggcaacaccaacattgaaccctgcaaaagcgggcgaaacagcggttagtgggactgttgaattaggagacttcccagaagggaccacctttgaagctatcatggtcatgccaaatggacggacccgaattgttcgtctcgatagtagcaatgccgcagctgatggaacctttataattcaaacggatgcattaaccgccggacaagtagttcaagtgaagattatcgctactaacggtacctttactaaggaaagtgcaactgctgaaatgacagtcgcagctgccaatccaacgaatccacttgaaaattacaacgtcgcagaacccgttgtcgatcctgttaaggcaggcgataaagctgtgaggggtagtgtgacatttacgaaaccaattccggaagggactaactttacagcagtggtgacattgccaaacgggattcaagtgagagtaccagttgatgaaaatggtcaattcgcagcccgtgttgatggtctcaaagctggtgatcgaatcattgttcaaattcttgcggagaatgatggttatcaaaaagcgagtgttccagttgatattctggtttctgccagcgatctcggtaatcctggaggcaatggcaacaataacggtaacggtaacggaacaggtaataatggcaatggtaccggtgatggcacaggtattggcaataacggttcaggtttaggcaatggccaaagcggatcaagcaatggtcagcttggtagtcacggacctggtacgttaaaaccattatccattagctcaaaagccttgaatcaagctaataatcgtcaaagtactaatggtcaacatttaccacaaactggtgagaaatcaaccagcgtttggagttggctaggtatgttggtattaacagccgcactattcatcaaacgtttagtcccaattaaacgcgataaataagcggcaaaaaaggaatcagcgcatatgacgctgattcctttttgcatggggatgtgttaaatcgcgttagtggggattgaacccacatggaccagtgagcgcggttgagaaatgattgtgccttcgaaaccaaacattcttaaccgcaaaaaccattaccgattctagggaggaatttcaaatggactggttcgttttaccgttaaactataacgcattgggtgtgttagatattcttagggaggaatgatctaaaaaacacgtgggtcagattgtttcttgggagcaattcatctgatgtataaagaataacaagcaattatgaataaaatgtgacgaaaaagccatgaatttgagagaaatttaaaatgattgacgaaaagtaagtgtttttgtttgtgaagtattttgaaagcgactacaatttgtttgtaatcattaatagggggaatataaatgacaaaagttttgattttaggcgcgcacggacagattgcacaattagcacggcaacaattattagcgaatacggatgcgcaattggtgttattcttgcgcaatgctaatcgcctaacggttcaagacgccgatcgtgaacaaatgattgatggcgatgctggtaatcaagcggatttagaaaaagcaatgacgggcgtttcagtggtttacgccaatctagctggtcggaatattgaagcgcaagccaaagcggtggtggccgctatgaaggctactaacgtcaaacggttaatctggatttcaacattggggatttatgatgaagttccgggggcatatggtaagtggaatcatcagatgttagatgatggctacttaccaacttatgcagcggcagcaaaagtcatcgcaacatccgagttggattatacaattatccggccagcatggttggacgataaggatgaaatcgattatgaaatcacgcaccgccatgatatctttaaaggcaccgaggtttctagaaagagcgttgctgcagaggtggtacgcctcattcaatcgccaaatgaagccatcggcgattcattgggattgaataaacccaatacagacggtgataaaccagcttggtattgaaaaagttgttgaaaaagctccaccgattcggtggggctttttcaacgctagatctgtacgaattaagtaagcagtgtatactgtgacaagcatcgggtaggagggtgaccatttgaagaaatcagctatttttttgacaataacattgttgtttatgatggcttttacatcaggatgtcaaaaagacgccacaaatgaaaaaaaccaacaattcggattaaatttgcaatctaccatatgacatcattaattttggaccgattcagattcaggatgctaatccctacatggaatcttacgaaacgcgatacaagcggtatattccagtgatttacgaatttgtagaagcttttattgatcaaattccatttgatatcaagaaatacctaaacttagacgatgcgaattatcaaggtttcgtgcaaacgatgatttcgatgacgatgaccacgtacatgtttaaacaagatgtgacatcggtgctcgctgcccaaatgatggaaagcgttgaatacctcaagccaaatgatgtcctaaaacaaaatattgatgatacggtggattacttgttaatcaatccgaaagtatcattcttagtcaaattacgtgaagaattggtcagtggttactacaacgtcttgcgtcagatgattcaacggtttgcaccgctgaataaagtgaaggttgtcgttgtgacggaacaatccttcctcgggtaccttgatttgatgactgcactgaatagtgttttgtatgtggatgttagtcaatctgacgcagatttaagagatgctgatatggtggttacgacttcgagcattgatttaactggcatcgttaacccagaagcggtgatgtttaaatggcatcaaaatgcagatagcgatcattttggacgtatgctcggattattacggggtctatggattcaaaaatcatctattgatgattgaatttaaagattaaatgcggtattcttacattaagaagtaaacacgtgaataagcgcctatatggattgacagagagataccggttggtggaaggtattgaatccagcattccagcgcaatagtgggtagtgatgaactacacggttcctggccgttatcagtaattgagggcacctattatttgtagtgggtgaacttgggtggtaccgcgaattgaagtcttttcgtcccaattaagggatgaggaggctttttttattgttgttaattaaagatcattaaaaggagagagtgcaatgttagatattaaagtcattcgagaaaatgtccaatgggcaaaggataagttagctagccgcggtgttcaagctgcagaaattgatgaggtcatcgcattagatgaaaaacgccgtgccttaatcgtgaagaccgaagaattgaagaaaaatcgcaatgctgcttcagaagccatcgccgttgccaaacgcaataaagaagatgcgactgaacaaatcgctgccatgaagaatgttggggccgaaatcaaggctttggatagcgaattggctgaagtgaaggccaaagtggactacatcttagtccgcttacccaacttcccagatgattcagcacccgttggcccagatgaaagttttagccgcgaagaacgcaaatggtcaacaccccgtgaatttgattttgaaccattagcacactgggatatcggtgaaaaattaggcatcttagactttgaacgcgccgctaaagtatcaggtagtcgctttgtttactataagggtgccggtgcacgtcttgaacgggccatttataacttcatgttggatcaacatgctaaagaaggctatgaagaaatgattacgccgtacttagtgaatggcgaatcaatgtttgggactggccaatttcctaagtttacggaagatgtttacacaatgactaacgaaggcgaacccatgactttgattccaaccgccgaagtgccattgacgaacttctaccgcgacgaaatcttggatggcgcacaattgccaatctacttcactgccttatcaccagctttccgttcagaagcaggaagtgctggccgtgatacccgtggtttaatccggatgcaccaatttaacaaagttgaaatggtgaaattcacgaaaccagaagaatcattcaatgaactagaaaaaatgaccgccgatgctgaaaatatcttaaaagcattgaacttgccatatcacgtcatcacattggcaactggcgatgccagcttcacatcagctaagacatacgatatcgaagtttggttaccagctcaaaatacgtaccgcgaaatctcaagttgttcagattgtacagacttccaagcacgccgcgcccaaattcgttaccgtgacgaagatggccacgtcaacttggtccacacattgaacggttcaggcttagcagtcggccggacagttgccgccatcttggaaaactatcaaaacgaagacggcagcgtcacaatcccagaaccattggtaccatacatgggcggcatgacgaagattgaagcaaaataattaatttaataggaaggcatttgtttcttccataagagagacggttgttatataaataacgaccgtctttttttgttagattagaaacagttgtgaatagagaatagtttggcgcataagacttgaaatttaaatgaaaaaaggttagactaatttagttatcgtggatattgaatgtaatcaattaagcagcttatataattaaaggagattttagcatgaagatgatccaaaacgaatttaagttcattgccaagaatcgtttaatcatgatttcgttaatcgcaatcgtgtttattccattcttgtacagtatctttttccttaaatctgtctgggacccttatggtagcactggtgaattaccagtcgctgtcgttaataatgatcagccagccacttacaacggtgaaacgttgagcgctggtaaagatatggtaaaagaattgaagaaaaacgaccaacttggttggcgtttcgtatcagcaaaaaaagcacaacaagggcttaaagataaggaatactacactgtagtgaccctacctaagaacttctctgccaatgctgctacagtcttggataagaatcctaagaagatgcaaattcaatacaaaaccaacgattcattgaacttcatcggtgaagttatcagtgaaatgggtgccaaggaattgaacgcccaagttcgggaaactgtcacaaatgcttatgctaaagtgatgtttaaacaagttaagactgccggtaaagggttcagtactgctgccaagggtgctaaacaattaacagacggttctgtaacgttatcagacggtttgaacgtttatacagccggtgttgcccaagtcaacgatggtatcatgacgatgaaaacaagcgttgtgccattatcagatggtgttaaacaattagctgatggctcaaacacacttaacaacggcttactattattagatagcaagacgggtgcactcgcatcaggcgcaagccaattagatagcggtgcaggtcagttaaacgctggtctccaaacattgaacagtaaaacaggtgcattagcatcaggtgcaggtcaattaaacgatggtgctgctcaattaaatactggtttgaagactttaaatagcaaagcccccgatttatcaaatggtgttaaggcattgaatacaggtgctagcgcattaaatgatggtgttaaaggttatacagatggtgcaagcaaactaaatggtggcttacaagagttaaatgaaaaaagtagtgatttaagtgacggtgttgatggtctatctgatggtgttacagctttaaaggcggggagtcaacaaatttctgatggcttacaagtcatgcaaaagaagttaaatgaaaacccaactttcgaaaatgaaacagcatataatacggctgttgcccaatattcatcaatcaatggactcatttcacaggtacaagcaacaattccagctttacaaagtgatttgaatgctattccagatcaagttgctacaacgacagatttcgatgcaaaagcacaaggcatcattgatgctgaaaagcaagcaggaattgtctttacggcacaacaagaagctggcatcaaagctaaattgtcagaacaacttaaagcgtctgctaaagacgaagcacaacaaattgttagtggcattaacgccaaaattgatgctcaaaagccaacagctgatgaatatgctaagttaacaactgctgttaatggttcattatcaatgctttcaagtttaaaacaaattcaaacgggcttgaatgatgtaaacggccagccaggtttagtaactggtgctacaaaagttaatgctggtatcgatcaactcgcaacaggttcacaagcactcatcgcaggcttaaataaatatacagatcgtgttgcaagtgctgctaatggtgctaatacattaacaagcatgaatagtaagttagtcacaggtagtgcacaattatcagctgggacaattgcgttgaatggtcaaattcctaccttaacaggtggtattgggcaactatacaatggttcaaccgcattatatatgggtacaaaccaattaaacggtcaaattccagccttaacaggcggtgttagccaattagcaactggttcagctgcacttgctgtcggtactggtgctttaaatgcccaagtacctcaattgacaagtggtatcagtcaattggctactggttcaacagccttgaacaatggtcttggtcaattaaatggtcaaattccaacgttaacaagcggtgttgatcaattagctgctggtacaaatcaattaacggataactcagctaagttaacagatggtgctggtcaattaacagatggtaataaaacattagcatctgcattgaaatctggtgcaaatgaagttaactcaattcaattaacggataagacagccgatatgtttgctgcacctgctgaattgaaacattcaaattacagctatgtgcctaactacggtcatgccttagcaccttacgtcctttcagtagcattgttcgttggcgcaattgtcttcaactttgcttatccaattcggaagatctcaatgactggtcaatcatcaacagcatggttcttaagtaaaatcacggttggcgctttagtcgctgtcgggatggcaattatcgaacctgccttaatgatggttgctggattaaacgtcgatcatccagcacaattcttcctaatggcaattaccttctcacttgcttcgatgtcgatcattatgttcttatcaatggcatttgataatcctggtcgtttcttagcaatggtcctcttgatgcttcaattagggggttcaggtggtacattcccaatggaaatcacgaaccacttctacaacgtcattcacccattcttaccaatgacgtattcaattctagggctcagagaagcaattacatctggtttaggtaccggtcaaattgttcaatcattctttgttctcttagccttcatcgtcgtagcactcttgctattatggttaggaatgaatcatttacaaaaaatcggcaacggtggtcgctcacaattagacgacaaccaaaaattacaagatgtcgaaaaataatcactagaaaaagcctgtcagctaaatgctggcaggctttttttagtgcaattaagtattcttaacgtctaagaatgtataaccgcggcgatcataacggttgcgacttcttgagtattcaatcggttgaccattatcgagataaacaacttgttcgacttctaagacgggatcaattggggcgcagtccagatattgctggtcatattcatcggccttatcggcttgaatattgcgaaaggcacccgcgaacgtgaggtgtagggtctccttaaggtaggtatagattgactgtgcgagaacatcatcggttaatccgggaactagactcactggcatgtaggtatgttcgaggacgctattaacgccgtcgataatccgtagtcgaatgattttgtagacgggctgttgatcagcaagcattaagcgctctttaatttcaggcgttgggaaagtcacctcaaacgtgatgaccttacttgagagtgttttaccaatgtcggctaagtcgcgtgacatcccacggtattgatcagctggtgccgttgatttattccaaaaagagtggtctaacacctttgtaccagcgccgcgtcgtgatagaacgagtccttccatcgttaaaatcgtgattgcttttttgatcgtcattcgactggcatcgaattcttgaactaagtcggtttgattgggtaacaacgtattagcaggatagcgcccttgtttaatccgttgtcgaataatgttggcaatttcttcgtattttggcaaaaaaaataccccgctttctacttatagtttagtggaaacaacggggtaaaacaatctttagtttgccagaggatctttttggcgatctagcattttaatgaatgggaaccagatgagaccgactagcacaacgtcaatgagttgtaagatcccgccgagtactgagttggttgcgagcatcccactgaagaagattgggacggtccatgggactgaaaccccagttggcgcaggcaccaatccgattgccattacagtgtagttgagcgctgtgacaatcagtggtgcaatcagccatggaatgaaaattgtggcgtttaaaacgattgggaacccgaaaatgacaggttcgttaacgttgaagacagcgggtgccaaggctaaacgtccgacatcgcggtattgttttttcttcatgacaaaggccatcagtaagacgacggctaatgtcatcccagaaccaccgagacctacggtgaaagtttccatgaatggtttcgtaacaatatgtggtaaagcatggccagctttgtaagcttccaagttttcgagcattaatgtgttccagatcggatccattacggagttgacgataatttgtccgtgaagaccgaagaaccagagcaattggacaaagaacaatgcgattagggttgcaggaagactgccacctaaaccaacgagtggtttttgaataatttcatagatcacgtcgtgcaagtttacgtggaataaaccagtgactgccgcttgaacgactaagaaaatggttaaggttaaaatcgctggaattaaagcggcgaatgatttcgcaactgcaggtgggacaccgtctggcatcttaatttgccagccttttttagtaatccggcaataaatttctgcagcgataaatgccgcaatcatcccaatgaacatccctttagcgccaaggcgatcgagacttaaaacaccgctaacgtcaacgcctttatcggtggtcatcatgaatggggtgaggattaggaaactggcgaatgaaacagcaccgccgaaaatcccgtccacatcatatgaattagaaagataataaccaatcccgaatgtgacgaagaccgtcatgattgacattgtggcattttgtccattaccaaggagttccgttagggtcgctttggtggcatcgttgaaaaatggcaggttagtgataacgacgatgattgatccaaatatcgtcagtgggaatgaaagcataaatgcgtctcgtagaacagttaggtaacgattttggcctaacttatttgcgaaaggcatgattttcttgctaagcgtgtccataaaagtattcacgtagagcaccgtcctttacatgtgtttgcaatcgattacattctcaatatagcacgctctttttaaaaagtctagacatttaaataaaagagttggttttttaaaaagaagctgatatactgaggctattcaaacaagaaggagtgctagcgatgactttttatgactttccaaaggatttttggtggggttcagcagcaagtggtccccaaacagaaggctggattgacggtgatggtaagggcgataatatttgggattattggtatcaacaagcgccagaaaagttttttaaccaagtgggcccagcgcggacctctgatgtgtatcaacaattcaaaagtgatatccaattgatgaaacaaacagggcacaatagttttcggacatcgattcaatggagtcggttgtttccacaaggtacgggggagattaatcaacaagctgtcgatttttataatgcgtacatcgacgaattaatcgcaaacggcatcgaaccgtttatgaatttataccattttgatatgccgctagcactccagaaaaaaggtggttggctcaatcgtgagacggttgatgcttacgttcattatgctgaaacctgttttgaattattcggggatcgggtgaagaaatggttcacacacaatgaaccaattgtgccggttgaaggcggctatttatatcagttccattatccagctgaaattaatttagcgcatgcggtacaagttggttatcacgaaacattagcgagtgcgatggcgattcaaaaatatcacgcacgcaatcaagggggacaaattggcattatccttaacttaaccccaagttatccccgggatgcgactaatccggcagatgtgaaagccgcccaaattgcagatgcttttttcaaccgttcattcttagatcctgccgtgaagggggaattccccgctgatttggtcgcgattttaaaagatctagccatcttacctgactatcaaccagctgacttagcattgattaaggcgaacactgtggatttattggggattaattattatcaaccacggcgcgtgaaggccaaggaaaccccaatcgaccatacaaacggcccgatgccggatgatttcttcgacaattacgatatgccgggtaagagagtcaatccgtatcgcgggtgggaaatctacgaacgtgggatttacgatattttaaagaacgtccgcgaaaattacggcaacattgcttgcttcatttcggaaaacgggatgggcgttgaaggcgaagaacgttatcgcaatgcggatggccagattgatgatgactaccggattgaatttgtacaggatcatttgaagtatgtccatcaagcccttcaagaaggtagcaattgtctcggttatcatatgtggacgtgtatggataactggtcatggaccaacgcctataagaaccgctacggttttattgcggtggacttagaccatgattgccaacggacaattaaaaaatcaggtcattggttcaagcaggttgctgatcaaaatgggtttgaagcctaatcgaattgaaaaagcacaatcgacgaaacaatcgttgattgtgcttttttgtctgttatattcgggtaaacttgataaccatcaagttcttaaaatcggctttcttctatactaaagacaatcgttaggaagaagggattttaaatgaaatttcaaagatggttacaatccgtgaagaatcagattgcgctgactgttggcggattgattgcagtggcctatggctggtactggcttggtggggcggtaattgtgatgcaagggctgttattggttgcgtcaatgatgggggttgcaccgattttgatgcaggcgtatcaagcgctaaaagtgaaagtcgtcagcattgatttgctggtcacgattgcggtattgggagcgctaatcattggtgagttcaatgaatcggcgattgtcacgttcctctttttattcgggagctatcttgaacaacgaaccttgaaaaagacacgagaatcaattcgcgcattgtctgaaatggcgccacaaacggcacaagtgttagcggccgatggcactactacgacggtagatgttgatgatgtcgaaatcgatgatcaagtattggttaaagctggcgctcaggtgccggttgatgggcaagtcgtccaaggtagtgcctatgtcaatgaagctagcatcactggcgaagcacaactcgttaagaaaatagtgggtgatgctgtttattccggggcaattgtggataacgggacattgacggttaccgcaacgcaggttggggatgatacaacttttgcccaaattattgaattggttgaagaggcccaagatagtaagtcacccgcggaaaaattcattgatcgttttgcgacgtattacacaccggccgttttagtgttggcattagcgattggcttaatcacgcgcgactttaaactcgcgattacgattctggtgcttggttgtccaggtgcgctagtaattggcgcgccagtttcaatcgtggcggggattggcaatggtgcgaagcatggggttttgattaaaggcggcgaagtcgttaatgcgatggctggcattgatacgatggtctttgataaaactgggacattgactaaaggggacacggcagttgcacatgtgcaattttatacagcggcagaacaagcaacgttggcagtgactaccgcggttgaagcacagtcagatcatccactggcgactgcgattgtgcagtatgcacgggaacgaggggtgacagacttaccaactattgaacgaattgaaacgctcaaagggttgggggtacaagctgaagtcgctggtcaaacaattcggattgggcgggccaagatgatgactgaagcagggatccggttaaccggtgcgcagattgcggcgatcacggccagtcaaacagcagggcaatcaaccgtgttagtcgcagttgaccaacaagttgttttattaattgggattgctgatacggttaaaccggaagccaaggcagcattaacgcgtttgaaaaaagcgggcgttaaacatttagtcatgttgacgggcgataatgaccagacggccgcagcaattgccaaagccgtcgggattactgaataccacgcgaatcttttgccggcagagaaggttgaattcattaagacctaccaagcaaacggtcaaaaagtggcttttatcggggatgggattaatgatagtccttcactcgcactggctgacattggaattgcgatgggttctgggacagatgtcgcgattgaaacttcggatattgtgttaatgcaatcgacgttatccgaattagtgtatgctgattacctcacgaaggcgacggcacgtaatacagttcaaaatattgtgattgctgttggaacggtcggattgttattgcttggcctgatggttggctgggtacagatggctagtgggatgtttgttcatgagattagtattctggtcgtgatattcaatgcgatgcgcctgattcggtttaaagttcgctaaacttgatggcggtcaatttttaatcatgcagcgcgcggtatagtaacagtaatcaaacgaaaaggtggtcattgaaatggcaaaattggtgatgcaattagacgagctatcatgtccgtcatgtatgcaaaagattcaagcgggtgtcagtcaacaagatggggttgaatcagtgaaagttctctttaatgctagtaaagtgaaagcagaatatgatgaagccgtgacaaacccagatgaattaacacaagctgtaactgacttgggctacagcgttcaaagtatcaaagtgaaatagggggcaattaatatgttatctaatgaagaaatcgaaacacgttaccaagcagaagttaaacaagctgatgttgatcaccatacaccaaccgcgggtgccatgatcggccatgtgatggctaacttaacgattcaacggcgtaaactccgtcaaatgaagtggtacgctaaaggaatcaataaccaagcttttaaagcgcaattaaccacattgcttgcagaaaatgatatgctattagacaagacggccgaacggctactagacgaaggtgaagtgcttccgacgacgcaagctgagtataccgagtatgggatgctgacagaagagccgcggattaagtactgggagatgccagcgatgattgcggaaatggttgcggactataatactgctaatctatttgtttcccgtgcgattaaacttgcggaaaaagaagaacgatttgctttagcgacggatatggtttctttaatgggctacaaccaacaccaaatccgtgaattgcaaagccaactaggaaaagcagcgcgcgaaggattagatgaagaagacgacgattaagatagagggaagtgggctaggtgactgacgaacaacatatttgtgctgagatagtaccgatttttaatcatttagaccgtgatagtttggtcaagatttcggcagttacccatcatgaacgcgttaaaaaagggacgttggtgatgagcccgatggatcagaagcggttagtgatcttagctaaggggagcattaaggtctatcagctctctacagcaggcaaagagcaactgctacgcatgatggaacccggtgattttgaaggggaaaagttactttttaaaacggaagatgagccgttgtacggtgaggtcttgcaagatagtacaatctgtacgttatcgcggagtgcttttcaacagttactgttagcctatcccgaaattagtttaaagttactagaagcaactactgataagatgacgcgtttggaaaaacaggcgaacttaatcaatatcgagtcagttgaatccagaatcgtgacttatctacttgatttagctaaagcgagcggagaaactgaagtgatgattccgatgaagttaaaagaactggcaacatatattggaacaacgcctgaaaccttatcgcgtaagttaaaacagttagaaagtcatgcgctaattgaacgaaacggtcgaaagattgcgatattagactatgaaaacctagaagacttctattaggacgtgaagattctgcgaattttgcaggatctttttgtttacctataccaatttggataaaattggaacaaatagcagtttaaaagtattatgagggataatcaatagcgcagattagggatgagaatccgggtgatatgaattattttttcgatatttatacaggaattcaatttttttgaatttttttcaaattagtgattgacgttgtcccactaggatggtaagatattctatgtcgtcgagagatgagcatgtagcaaaacgttgaatgaatattacttaaaaaagttgttgacattcgggtttatacatgataagatagattgtgttgcttataagttttaacttaataagtgattaactaatatctgatcttaaaaatatttaattatttaaaaatcttgaatattgaattaccgcccaatgttaagggggttattcacaatttagtgtgaaaactaagtgttttttattaaggtgtattccagaaaaggatttctttttaataaaagttatactacaatagaaaatatcgtgattataatagtatataatgtgattgattatttttttgtttagttttcgaggaggatacgaaacggatgactgcagaagaacagaagcgacaccatcaccataagcaccggcgcagagggtggacattaacaaaagtgattttagttgttcttggggtattgattcttgccgggggcgcattcgcagctaaggtctatatggatgttaatcaaaccgccaagacagtgtataaatccaaaggtaagacacaaaataagcgcaaagttttagaaaaagtcgaactaaataagaagacgcctttctcgatcctcttactcggtacagatacaggggaactaggccgaaccgaaaaaggccggactgatacaatgatgctcgcaacggtcaatccaacgactgaggaaaccaacatgttgagtatcgcccgggattcacgggtaccaatcgttggctatgatcaaacggctaagattaatgccgcgtatgcctatggtggcattccaatggcagttaacactgtccaagccttcttaaacgtaccagtcgattattacgtactggttaacatgaagggcttagaacagctagtggatgcagttggcggcgttacggtcaataatgatttggacttcacctatgaggggcaccacttcgaaaaaggaacggtacaattagatggatcaactgccttgaaattctcacggatgcgctacgacgatccacgcggagactttggtcggcaacttcgccaacaagcaattgttcaagctgttttgaagaaagctacgtcattaaacatgatgacgaattataacaaattcttgcaagtcttagaaaataatatgcagactaatatcactttgaaggatgtcttaaatattcaacaaaactatggcgatgccatgcacttcaagacacttcaactaaaaggaacgggtcaaatgattgacgggcaatccttccaagtgatgaatccaaccgaggtagcacaaatgtcgacacgtttacggaagcaattagatttgaaataatcatgaaagaagctaaccagtgatggttaacttctttcagcgtggagtaaagtaattataattgttaattaattttggagggtatcatggagcaaacgattaatattgaacagattttcagcattttacgaaagtatcgccgccttattctatcatcaacggttgtatgtacgctgttagcaatcattgttacgtttttcttgattacgccacaatatagtgcttcaactgagctcttagttaatcgtaaacaaagtacagatgttggtgcacagctgaatcaggtgcaagctgatgttcagatgattaacacctataaagacttaattacgaaaccagttattatggattcagtagcaagtaagatgaataagggggatggccacaaacttactgctggtgaacttgctagcatgcttagtgttgctaataatcaaaattcgcaagtcttctcaatcacggctaagtctgataacgcctatactgcggcagatattgtcaatacaacagcacgaatattccagaaaaaagcacctaaaattatgagtgggactgacaacgtctcaatcatttcagaagccaaaccgaatttaacaccagtgtcacccaaaaagaacttgaacgtcttaattggtctggtgttaggggtattattaggcgttggggttgcctttgtacgggaattaatggacaaaacagttaaggaagaaagcttcttaacgcaggaactcggtttaaccagtttaggaattgtcaataatattgctgataaagatttgattaaaaaagcgattgtcaacgtaagtagcagtcgcttatcgagaagaggatagggaaatgggcttatttaaaaaagaaaagagtttagatcaagcaagtatgaaagaaggggtcggtttaattacgttaacggaaccgacttcagtcattgcggaacaattcagaacggttcgaacgaatattcaattctcgtcaattgatcaaaaattacggagtgttggcttcacatctgctggcccattacaaggcaagtccacggttagtgcgaacgttgcagtaacttgggctgatcaaggggttgatgtgttactagttgatgctgatatgcggcggccaacagtgcatcaaaccttccaagtaccgaacaaacgtggacttacatcactcttaacggaggaaacatttgatttaactaatacgattcaaaaaacaccagttgatcatttatttgttctaccatgcggggttgtaccacctaatccatctgaattactgaatacgaagaagatggataaattaatccaagagttaacaaagcattttgatttagtgatttttgatgtaccgcctgtaatatcggtgacggatgcacaaatccttgctagcaaagttgatgggacaattttggtggtaccacaagggattgttgaaaagggttcggttgccaaggcaaaagagttgttagaagtcgttaatgcccgaattttaggaaccattatgaaccgcgtgaaggctgagaatacgggcggctattacggtggttattacggagcagaagataaataagtaaccaaacctttagtagctacttaggcgtttttggttccgaggtcgaagactttacgcaacggatcattgatgccggcttaggctttgtttttgcctcagacgcacataacttaaagggccgtaattttcgtatgcagaaagctttcgctaagctagagcagcataatggggcggaaatgatcacttggatgcaagataacgctaaaaagatcattaatggtgacgacttggaaccaagtgagtaccaccatattaaagagaaaaagaagttttggttgtttagataatagttgggaggatttactgaatgatgatcgataagatgggagaacacaatatcaaaccaagcatcacagcttataaaactgcacgcttagatcgggttacgcttgaccatagatacgcctattacagtattcagcgattgttcgatattgtcgctagtagtattgctttgatcctattggctatcccattcttaatcgtcgcaattctgatcaaacgcgacgatccccaaggtccagtattttattcgcaaatccgtttgggtaagcatcaacggccatttaaaatgtataaatttcgctcaatgtttgtagacgctgataagaaattggcggacttgttgaagtataacgaaattgatggcgccatgtttaaaatgaaagcagatccacgagttactcagattggacattttattcgtaaatatagcattgatgaattgccacagttgttcaatgttctcaaaggcgatatgtcgctagttggaccacgaccaccgttggagcgtgaagtagcgacttatagcgaatacgctaagcagcgcttatacgtcaaaccaggttgtactggtttatggcaagttagtggtcgtaacagtgtgggctttgatgaaatggttgaattggatttacagtacatagaaaagagtagcttctggtttgacctgaagatcatgttcttgactgttaaaattatggtttggccaaatagcgcgtattaaggagtaaataatagtgaaagtatgcttagttggttcaagtgggggacatcttactcatttatatatgttgaaatatttttggaaaaatgaggatcgtttttgggtaacgtttcctaaggaagacgcgaagtccttattggctgaagaaaaggtttatgcgtgtcactatccaacaaacagaaacttaaaaaatttgattaagaatacttttctcgcatttagggttctttttaaagaaaagccagatttaattatttcttcaggtgctgcggtagcagttcctttcttttatttaggtaaattatttggtgccaagactatttacattgaagtatttgatcgaatggataaaccgaccgttacaggtcgactggtttatccagttaccgataaatttattgttcagtgggaagaaatgaagaaagtttatcctaaggctattaatctagggagtattttttaatgatatttgttactgttggaacacatgaacaaccatttaatcggttagttaaagcggttgatgatttaaaaatgagcggtaaaattactgattcgggttttattcagactggttacagtacctatgtaccaaaagcatgtgagtataaagattttatttcaatgaatcaaatgaatggaatcatcttattaagatgtcatcgtaattcctacgaatgtggaagtagagctcctcaccaaataatgtttttcgtctcgtatatcagtagtaagtgtatatgtatacgaataagacatacagcgttgagggggtcatgggcagctcacggtgactcgatatttcaccaattagtttgtagaatagtgaaggcccgtgttgagtttgaagctaagattgattactcgataattgatagtgttgttgacgttgaatggtctgattttagcgaagttaatcaaagtacggttaccggagaccatggattactatggagctataattggacattacctcgacgatgttcttattagatacgcaagcaagaatcttgtgtcgtgcaaggagtttaaattacgcaaagtgaatctggaggtgggatgctgcccgaagtacattgataagaaatagctgatgtttgaaattgtcgagatgagattgaatgttattttcccctctttaatggagttggcttagtgaacaattgaattgtagggtcattaatagttcaggttgacttcaaaattgcgtgtgcaaattcatgttattatcattgggttaacgaaatttcatttgaagtgtgttcaaaaattacatttaaatcacaatagaggtgtgctcgataaattgtaatgattactcgtaatcaataggttagtatgtaaagatacgcatttaaataatagtattgggggacgaaacgtgaaggttatccatgtaggtgaatatgtctcagggggtgttgccacttacctaagaactttagtgaattgtcagataaaaaataaaaatattgaagaaataatcatttttaaaagtgcattaaattctgaaaagctcatttttgattcatcaaaagtgaaagtgatttgttatgactatagacgttctgcaaaaggtgtgtttgatttgttggccttatggaagcagattgttgaaatgaagccagatgtggtgcatttacatagtacatttgcaggattattacgagtgaaaaaattacttagacgtgtgccgtttaggattgtctactgtgcccatggatgggctttcactcgggattcaattgaacttaaaaatcaaatttttgcaaaggttgaacgtgtcttgtctagaggttgcgacaatattattaatatatcagaaagtgaacagtttgcagcgttagattatggactaccagcaaaaaaaatggtagcaatcaataatgcaatagagattccaaagaaattaccttcaaaaagtaaaatgtcaggaaagctaaaggttttatttgttggacgatttgatcgtcaaaaaggtgtagatattcttattgatgctgcacgtgagcttcaagatattgattttcgtttggggggacggtctgttgttggtggaattaatttcaaagatataaaaatacctagtaatgttgaattgttaggttggttgagtactgaacaagttgccactgaaatgattcgtgcagatgcggtgattataccatcacgctgggaaggttttggattagtagcgttggaggcaatgaaaaaccagtgtgctgttttagcaacagatgtaggaggattagccgaaattgttagagcgaatgaaaatggcattttatttgatgcagacagtaaggatgctattgttcagacgctaaaaattcaaacaagaaacaatttaaataaattggggaaacaagcgcaaaaatttgttgttgaaaactatgatgcaagggaaatggagagaagagttttttactactgctatctataaaataatcttcatttttttaaaaatcgaaacaatatagtgacactacaaatttatcgaacgaaagagattgacaaatgatgaaatataaaaaaatgattggcgattttttactcaatttaattgctaatatgcttaatgttggcttcttacaaataatcatgcttcctataatatcacgtaatataaatactagttcatttggacaaattacagcgatatatggaattaattcaattgtttttttgtttttaggaggtgcgcttggtacacttcgattaacaaagatggaaaaaagcggagttaattatacttacttatcatatcaaacttcaataattgcgtttttaatagcgctgattatttttaatatttatggtgcatcattaaacaaattcgatgtgtttatgtattgtataacggcagggctaatgagctacctaagttatggtggtgttatatatagactttatataaattataaaaaggttgtcatccaaaacgtagtaatttgcttgggatatttaattggactactactattttttttgacgaagcattggtcactgatattcttattaggtaatgtatttggagttatatatacccataaattttctcaattaagtcaagattctacacggaaaaactcggaatttagatatgtggttagagagtacgcaaacttatctattgctactctaataagtagtagtatcggaaacttagatcggatcatcttaattcccttgttaggtaattcatccatggccattttttttgctgctagttcggtatcaaaaattttaaatctggtgattaatccattggcgaacgttttactgacatatatttcaaacgaagaaagagaaatgggttttagtaaacttagtaaaatacaatttttaacttttatggtggggataattttatcttttccagcgtacatggtttcaatcttaatggttaaatttttatatccaactatatacaatggatatgatcacattcagctattaacgtatatagttagtctgggaactatttttttgagtctttggagtttgctaaatgcactttttttgaaaatatttaacatgaagtttcaagttgctagtaatacattatatggaattttttatctagtactttccatcagcctagggacgaattatggcttgttggggttcggaattgcttttacaatttcatcaatttttaaattcttaatatcatggatgctgagtctggtgaaaggcaaattctataattaatccgaacagaaattaaaaagcccaaagcaatcacttacaatggtagtagctaattccaaccaatatagggagtgattactttgggtacatctactttatcacgttttcaacgtggcgcactagctgggcacagtcgggaaagaaaacattgttaattgatgcggacatgcgtcgttcgatagcgcatgtcacctttgcattgaacaataatgaaggattatccactttgctggccaagaatggtgaaccagaaaaagtagttaaagaaactttcattgataatttgtcagtaatgactgcaggccctgtaccaccaaatccggcagaattaatagggtctaagcgtatggccgaagtaatggaatgggcgcgagatcattttgacttggtgttagttgatgccactccagttttagctgtagctgatgctcaggtggctttaaagtattcagacggaatcgtgattgttgttaagatgggaaaaaccctgaagggcaacattcagagaactgtagagcttctgaaaatgtcgaatgctagaatcttaggtgttattgaacgttttcaaaaatctgcagaacgtagtggtggctatggctatggttacgaaaaagctaatcagtaaaagctagagtcttttgggaacataaagtgaaatttgttttgaactagatagggggcagtactgtgcaagaaagagttgcgatagttacgtcaggttatttaccagttcctgcaacgcaaggtggtggtgtagaagttttagacgaatatttaattaatgaaaatgaacgtggtaagctagttgattttacagtgttttcgtcatgcgatggaagagctcaggaggtagcatcgaagtataccaacacgactgttaagtttatttatacgcctaagataattaaggttatggatagtatggtatattggattgccaaaaaagtattgcgagtaagcaagccaaattcatatagatatatatttcaacgtattagctatattaacaaggttgcacgtgatattaataagcatgattatgacaagattgtttttgaaaatcatgcaacgttattgtctagtttacggtacaagcaaaattttgaaaagtataagggaaagtatttctttcatctgcataatgaagttacaaaagattttggtaataaaaagtacattcaagagagcactaaagttttaggggtaagtgcatatataaatagtacgttaagtgctaagtatccagatatgaaaaatgaacaatttaaggtgttacgtaacgcggttgaccatagtcgatttagcatggagttatcggtcaaagataaaataaaaatacgcaaagatttagggcttgaaaaaaaggattttgtttttcttttttcgggaagattaacgaaagaaaaaggaattgttgaggcactgaaagcctttaaaatggccaatatccctaattcaaaattcctagttgtgggtagtactttttttgctacggatgttaaaagccaattcgaaactaagttaggccagcttattgaccagatgaataataaagttatttttacaggttttattccgaacgagtcaatgggtaaagtttacgctgcttccgatgtgagtgtgcttccatctatatgggatgatcctgctccgttaactgtgattgaatcgatcgtttcaggaaaaccaataattacaactgattcggggggaattcaagaatacgttacaccagaaaactctattacggtacatcgcgacaagcatatagttgaaaacatttcaaaggctatgttatatatgacaaatcatcaagatatgttagaaaaaatgaagcaagagagtaaaattattagttttgatttaacgactgagagattttacaacgacttttgtcgaattataaaggatgagagtaatgacaagtttatttgaatttattacaatggctttccctaaggcaggcatacaagtaagtgggctaccaattaccataaacatggttttgtttggtgttgttacaatcgttaattttaaatatatacctaaatatttaaaactaatgccgtcattcatattcccttattaccttcttgttatgtttgtagttataagcgttttaataaatattgggaatggaactatcacagcaatgactattgcaatgactgctgtggttactcttagtccgctcgccggattatctgcaatggcattgagtactgaaaaatcgtttaaaattgtatctattagttctattgtgacgggtggatatatgattattcaaaaaatatttggtataatagcgacttctattgcaggagtatcatatacgtacgggcaggatcttgcacacaaaaatataggttatactggtgatccaagctctgctgtaggtgaggcgagtaaaatgccatcaacatatcaaaatggtaatagtgtgggcttatttttagcaaccagtttggcgttgttactttcttggactcccgataattcccggtggaaaacgattagaaaagtgggcattgttatgtgtcttatcggtctaacactgtgtggttcgagaagtattctgtttcctatgttgctggtgagcgtatttatttttttcggatattttcgaaaattgaatggaaacgaaaaaaaatctctttttataaatatatttctatttttattaacgcttttgttattcctaaaaatcactcacagcgatgtgttgaatcaactggtagagcggtatattgcgcaaacaattgaaaatccgactagtaatcgtagcagcatgtgggcggatggatggcagtatattaacaatttaaatttgaagcagtttatttcatttgggataattggtgctccaaatgatgcaattggttcggatggaatgatgggatttttactaaatagaggaataattgcacaattgctttttatagcctgcctaggtattcctatagtacaacttatgtgtaaaaaagaaacccgaattgttgcatggagtcttgtggctgtgtttattgcatttattttggatatgtctttttattatctaccctgtgtgatgaatttttatctggcatttgtaattgcggggaaaagtcaaaattcagatgtttcaataacaaaaattaaaggagttctcccaagtgaaaatagatattctggtctctaatattggatccaaaggtggagtgcaaaaggttataactgattggattttgcactacaaggatacagataaagaaatacgaatcatattaccagctggaactaaagatgattcgtggacaaaaaatttcaatgtaaaaataaatcgatttgggaataatcgggcgagtcgctggattggcagcatgccttatcttttaaagtatgtatggtgcaccaaagcgaacgtgatagttgttgaacagtatagatttataccgataataaaggttttacggtttttatttaataaaaaatttttgatagtgtcatggatgcatcaaactttaaccgtaaaaaagaatatggcaatgcttgccagtaaagccgactatcatcttgcaatttctagcggaataaaaaaacaatttatagagcaaggagttaatccggatgatatttttttaatatacaatccaattgaaaggaaaaataaacaactatataaatctcctaaaacgaaagcaaagtttatttatgtaggaagagcgttattagatggtcaaaaaaatcttagagaaatgtttagtgcctttagtcttttaaaagaatatgaatggagtttagatctttttggagtagacgagaaagataatgaagacattgtaagggacgtaaaagaaaaaggaatttctgatcgagttacatacagaggatgggttgaagatccttggaaaaatgttagtaacccgtctgcactattattgacaagtaaatatgaggggctagggttggtgcttgctgatgcaatttcgtatggagttccagttatttctagtaatatagaaactggtccagacgacattgttgtcgataatgtaaatggttttttgtacgagtctggtaatattgaagatttgaaaagaaaattgttgaactttattaaaaatccttctctgctgtctcaaaataatattgaaaacacaataaatgagttttattacgatagatattttgcgaaattagatgcggcatttactttcatgagtcatttaaaatagtcagaaagaggataagcatgattatatcaactataggttatggagcaactggttcgggagctgtctatgctcttttgaaggaattttcatcaatacaggataaaagtgaagtagaatttaaattggcttatcaagttgatggccttgaggatttggaactgcatttaatgaaacggcatgctaaaaatgcttctggggatgctgctataaaacgttttaaaacattaattgattattattcaagggttcctcttacaaaaaagttagtcgatcctagtagctttaagtcaatatctaacgaatatttagatggtctgatacaggcatcctttaagggacttgaaagtattgataccgaaactggatcggttggtaaaatgattatcgcaatggcgtttaaaaaaaaattcattccattatttcaaaaaataactaaaaatccatataacttttggccaatacgggatatatacgtttcagttttaccagaaaatttcctagataagactaaggcctatgtaaataaattactggaagcagctggctttgatttgaatgggaatatcttactaaatcaagcttttgaggctaatgatcctgaagcaagtatgaagtttttcgagaactctaaggcaattgtacttgaccgtgatccaagagatttgtatatacagcatcagattatgacctctggtgaaggacgatggcttcccagcagaaacgttgaagcatttgtggaacaatttaaaagtataagaagcggacaaattaaagttaattctgaaaacgtaatgtttgttcaatttgaagatttaatttttaattacgaaaaagaatgtaataaaataatcgagttttgtgcgctagaaaaaaaagatcatgtttttaaaggtgaaaaatttaatctgtataaaagtataaacaatacaaacttgattgaagtttatcctcaatttaaaaatgatattgtttatatagaaaaagagcttccggaatttttgtatgattttaaaaacacagatacgactattaaaagaaatgggaatccgtttaatgcgtaacttaatcgtctcactttttttgtgtttcttcaaagaactttaacaaaagatttgccatacatcgccgtattagacgaagatagcaatttttacggaattctcacgcatagcacgttattaaatatgctttctgaagcgtggaatctcgaattaagtagctatgtactcactgtgctttcttctggtgaacaaggtgatttggttgccatgtcgaagattatcgctaaatatacctcaatcgccagctgcatcaccttagatgctaagcaagatgaattcgtacgacgcacccttttcaccttgcctgctggacttgatcttaagattttgaaaaagattgtttataagctcgagaaaaaaggctatcgtgttcctgaaatcgatgatttacaatctgataaggcgctccgtgatgactccaaacttgatgatttagtttaacgcaaaaaagggcagtcctaattaggactgccctttttaatctttatgatttcatttgtgcatcaaagtgcacaactttatccacagcatacattactggtgcggtaatcaccatgatgactgcttctgaaagtgccaacgaaatatacgttggccagaatggaatgtgtgtgctagcagtagaaccggttaacacaatcatccacgcaatcatacacatcgaaacggtgaacaagagaatattgaccaccattttttgccaagtttgttttaaatagggcatcacaagcgttaatacaagcagcgccaataaagtttgcccgccaccaaaaagcgtatcgagtaacttgttttcagaactgaaaaagaaattgaacactaataccccaccgaaaacaccccatagatatttcttattgaagaccactaaatggtttaagccttccgaaattctaaattgaatggctcctgaagcaaatcccaacatacctgggaataacgataaaacaacgtataatgctgccactaacccgtttagaatcaccgtttttaatcgactttgattcgtcatctttgaatcctcctagtttttttgcgtgggatggttacgaaccacgttttttcgaacagctaccatcatatcatatttaccggctgttgataaaggtcaaaaaaaagagaacccgcttttataagcgggttctcttcattctttctttttggtatttatgtattaaggatttaagaccgctttaagtccaacactaatggtgagcgcccgatcgacttgtgccatcttatccgccactaaatgtgtgacgcgatctttcaagcgttgtttatcaatcgttcgtacctgttctaataaaatcacggagtcgcgttcgacaccattatccttggccgtaatcccaacgtgtgttggtaatttcggtttttgaatctttgctgtaatcgcggcaacgattacggttggactatggtgattacccacatcattttgaatgattaaaacaggacgcatgcccccttgttctgaaccgaccactggtgataaatccgcataaaaaatatcgccacgctgtattaattctcccacttgttctccctccaattaggatcaatcaactacgcgaatgtgtgcgtacgcctcactttcgcaagcgttaaattcagccgcaatttgactgttgatgctagccatctcagcgtacccgttaatgacgttatctacttttgactgtctggtcgccatgaattcgtgaagcgcatcttgaatcaaatcattctcatcaagggcatacacctcacaatactgcttaattgcttggaccaactcaacgtctaatttaacggatagttgttcacggttagctttcatctgcatcaacctccgaatcaacactttaacctttattcatcctaccacagaactggcgataatcaaattcttaatccttaatgttcatcaattccactgtaaacccgtggtaaccgatcagataaaccacagataatttcatagtgaatcgtccctgcataatctgcgatctcttgtaaagtaatttcgtcatcaccacttttaccaacaaaaactactttggtccccactggatattgcttaggtaaccgaatcatcaattgatccatgcagacccgaccgacaatttcacaccgatgtccatccaccaaaacggttgagccttgcatccgtctagaccaaccatcggcgtaaccgattggaatcgtcccaatccattcagattcactcgcttcataagtcgcaccgtaaccaatcttacttccggcttcaacttgcttaacaaagaccaattctgattcaagacttagcgccggtttcaatgcataaggcaattcaggaatcgcattccctgaaggattcaatccgtacatactaattcccattcgaattaaattctcattgcaagctgagtgccataaactcgttgctgaattcgaaacatgcacaaatcgtggacgttctggtaacacggctactagttcattaaaccgggcactttgttctttaaaataagtatcatcgggatcatccgcagttgcgaaatgggtaaaaatcccttctaaatcaaaatatttcgcatgtgctttgataaatgtggctgctgctagtaattcagtcgcatctctaaaaccaattcgccccataccactatccacactcaaatgaatgtgcattggttgtgaataaggtatttgttgggcaatttcgtaagcagcttgcaaccattcgagtgagccgaccgtaatggagatttggttggcaatcaccaattcgatttcggtgggctgtgtaatccctagcaccaaaatgggttccgtaaagttagcacgccgtaaagctaaggcctcatctaaaatagccacacaaaatcctgcagcaccagccgcttgggccgcttctgcaacaggaatcatgccatgcccataagcatttgcttttaagacagggaaaatcactgcatctgtgccttttaaatcctttagttcattttgaatattttcataaattgcgttttgatcaactagaatgcgtgttggtcgtaagtagccgactgtcatcgtctcaacctctttccaaaataacttctgccaccactaacgtcgttgtatgcgaaagtgatacgtggacagttccctcaaataaatcttgtttgatgtagggtttgccctttgcatcatttaacgtttcaatcgcttgcagttgtacctgtccaataccagtcccataagctttactaaaagcttccttcactgcaaagcgccccgctaaaaattctaacgcacggcgccccgtataccgtttaaacagttcatattccttagctgttaatactttttcagcaaaatgactattcttgctctgtgctttttcaaatcgatcaatttcggctaaatcaatgcctaatccagcaatcatcgtcttcgcccctagtaccctatttttaattagtttaccacaaaaaagacagagactgaacttacatctctgtcacaattgactatatgaaaacagcggccgaccaagttggccgcccgctgtttttaaaaagtcttatttatcgtttgtccgaattgtgaagttccgttttgaacggccatcagtcttcttacggttgtcacgattgtcattgctacgacgtttgctgctatcgccgttgccactgttgcgacgaccgtctttgttgtcattaccacgacgtttgccatcgccattaccacgacgattgccaccgcgatagccgccaccgttaccgccacgacgattgccgccgccattccggttgccgctacgattgccaccttttttacgtgaaggcaatggacgttctggtgttatcttaacaggaactgattccttgctgattgtcttcaaaagcactgaagctaattcaacgtcagagaattgtttcaataattcttcagcttcttcgctgaatttagccaattggcctttttcaatcattgagttgatgtctgcaaccgctgcagctaattggcccttgaaggcttctttttctgtaggtggttgtaatggtaacatccgtttcttcgttaagttttcgatgatgtgtaagtattccatttcgtttggtgttacaaaagtaactgaaacgcctgacttaccggcacgacctgtccggccaatccggtgaacataactatcaggatcttgaggaatatcgtagttataaacatgggtcacacctgagatatcaagaccacgagcagcaacgtctgttgccactaagatatctaaacggccagccttaaatgatttcaagacgctcatccgtttttgttgtgataaatcaccgtgaatcccttcagcattgtaaccacgagccttcaaaccgcgtgttaattcatcaacacgccgttttgtccgaccaaagattaatgttaattcaggtgattgaacatcgaataaacgcgtcataatgtcgaatttttcgaagtcctttgcccgcacatagtattgatcaattaagtcagccgttaattcttttgacttcactttgatcatttcagggttagtcatgaagctcttaccgattttcatgattggtgctggtaatgttgctgagaataaaagtgtttgacgttggtctggcacttgtttgatgatgctttcgatatcatcaacgaagcccatgtctaacatttcgtcagcttcatctaagaccaatgttttcacgtggtctaatttaactgtgcgacggttgatatgatccaataaacgaccaggtgtcccaacaagaatttgtgggtgatcttttaatgagcggatttggcgacgaatgtcagccccaccgtatacaacttgcactttcgctttacggtcgcgacctaagcgataaagttcttcttgtgtttggattgctaattcacgcgttggtgaaatgatcaatgcttgaatgttaggattgtctaagtctaagttttgtaagattggtaaaccaaaagcggctgtcttaccggtaccagtttgtgcttgaccgataacatccttaccagctaatgccaatgggattgtttcgccttggatgggtgttgcttcttcaaagccagcgcgttcgatggctttcataattggttctgataaacctaattctgcgaatttcaaatagtgttcctccttgttttgtaaaaaacatgccattacaaaacaggtccacttcgtcaattgcaccattttcaaaaatctgtcttgtaatataattgttttcaaaagcctttttcattaaaaaagctccctaatagcttatcatgccacaacttaattagcaaacggaattgctccaattgttaatctaattccatagcttcaatcgctaaacagcgtgcctgtgcagttgtctgtcaattgctaatcattaattaacttcagtatcttgtaaagcagcgactactttttctaaatgtaagccatgactcgcctttaaaacgattaaatcgtcaggttgtacctgcgcttgcaagccagcaattaattgcgtttgttcgtggcggttaaagtaatggaggcgttctggtgcataacgctcttttaacgtcacatataatggttcaatttcatccccgaacaagaagacttcttgaatcatcgcgggatctaattcttgggccaaactttcgtgtaatttcttgctggcagtaccaagttccaacatgtcgcctaagacggcaatccgccgcccgtcagtctcaaaatggctgaaattgtgtaaaacttctttggcagccgttgggtttgaattgtaaacatcactcaacatccgttcacccttttgaccaacaagccactctgtccgattacttgtgacttcaaaattcgccaaggcttttttcattaattctggtttaatatggaaccgttgcccaaccaaaattgcggccaacgcattattgacattataagcacccatcattggaatcgtaaacgtcatctctggccaagcattcaacttgaatgacgtttcagtttcacctgcacggacttgtaagggatataagtcattggtcgtcaaattaccgaatgtctcggttgtgagttcgccaacccgttcagtcaatagcggttcgtcgccagcgtaaattaatagaccatcttctttgagcccatctgtgatttccatcttagcattggcaatcttatcacgcgtcttgaaaaattcgatatgggcttccccgatcatcgtaatgactgcgacatctggcatggctaattcactgagcgcttttaattgacctgggcgatccattcccatctcaatcactaaaatttcagtattagcttccatcgataaaatcgtttgtggcacaccaatttcattattaaagttagcttgtgtcttgtgcatattgtactgactacctaaaacagcagctgtcatatctttcgtcgttgttttaccattactaccggtaatcgcaaccactttgggattaattttttggagataatgcatggctaacttctgataagccgctagtgggtctgtaaccactaatacaggaaaatcagttggctgtgcatcatgattggcagcccaaaaagttgccactgccccattttccttagcttgtccaacaaagtcgtgaccatcacgcataccagctaacggtacaaacaaagcgcccgcatttaattgacgtgcgtcaaacgcaacattcgtcacttcaatggttgcccattgttcaatatcgtttttagccccagtgactcgtgcaatttcacccaactgcattttcatatctcaataactcctattactctgtgtgcatttttacgcacgctttttttagttatggcttaaaatactatgcaatattgtaccatagtttcaaaaaagccccaaaaatgattgaccaccaattaagagtaccaccgtgaatagtcatcaacctgtttatcatttggtcgatattgttgcttagtcgggctccgccaccctttaaaagctgttttgcgtagtgcatgatcattttgcagcggtggttggctatctaaccgggcgtgttgccgatcattccgattagcataattaaacgattcaccgtttagtagttgccggagtgtgccatcatctagctggtaatggtcaggattactatcaatcagaccatccgcccttactttgagcacttgccattgactgataaatgctccggatggtgctagaataaattcactatgaaaatccggcgtgagtcgttttcgattccaatgcgttgttgggcgctgtccgttgcggtatttattatggagccgagctggttcacgccgcagccaataatgtggctgggtcgcttgtcgttttcgcacaaaccgcgctaaggcttgttcatctgtttcaccagagtgttgaaaataatggcggatatagcgtagattctgccgatctaaatacattctgaattgatgaatccgtttatcggttaaaactcgaccgacaaatgcacgttgcacactttgcgcaaaggttgctaaaaaaggcgcatctggtgctaattgcgggtcaagttgataatcacgtgctgttaattgcaaaaacgcatgctcatccaactgcgcccctaaatgcgtgagcactaaattgatccgctggtaattaatcactggttgtgcagttcggtccccatatgcttcaaaaagcatttgataaagtgctgagcctacttgatgtaatgcttgccaattgtgttgcaaaatccttttaagcgctgttggttgcgcagcaagttgtcccgttaaatgggttgcataagcgcgtaaactcgcaacgtcccaattagcgcgttctaactgttcaaaatgggccaccacctctgcctgatcaacaatccgataccgctgcggtagtgtttgccgccaaagatccattaattgagtgccatccgttttaattgccagcgttgtgatgatggcgcgttgaatcattgtgcgttgttgcgtcgataatgttagctggtgacgcgcatgcaatgccaataataattgcccacgcacaaccggtaaatcaatcatggtaatctgtttgctcggtgtctcattcaattgcattattagaatagattgtaacgccattaactgctggattggggataatcgcacactgatcactcctcttttcctttattatacaaaaaaagagagggacaaaaatgaattttgcctccctctatataaaacgtgttctatcaactattacctacagctgatgcgttatgtctttaaaacattacatcgctcttaatttagcgactcgttcttcaatcggtggatgactatcaaataaatgagcacccgaccgactaagtcctttaaatggatctgagatatacaaagctgcgcttgatggatccgcagcttgcattggctcactgtcagaaatctttaataacgcattgatcaaaccttgtgggttccgcgttaattcgacaccagatgcatcagccaagtattcccgatttcgcgacaacgccatctgtgcaatactagccgccaaaggtcccaatatcaacaataggatcgaaaaaaccaaaccgatgatattacttgcaccttcttcacggtcgttatcacgactgcggccgccgccccaccataacatgttgctgccgatgttcacgagcattgaaatcaccgcagaaagtgccaaggcaatcgtttgtaaccgaatatcgtaattgcgaatatgggagacttcgtgagcaattaccccctcgagttcctcccgattcaaacgcgccatgatgccagtcgtgaccgccaccgcagcgtgttgtggatcattgcctgttgcaaacgcgtttgggctaggatcgtcaacaatgaaaacccggggtatcggtacttgggcgaccatcgccatgtcttcaacaatgtgccataaatcaggatattcgctagcatcatggacttcggtcgcatgattcatctgcataacaacgttggttgagtttccaatcatcatcgccatataaacggcggctaaaatagccgccaccacgacaccactaatcaaattacgcataaacagataccctaatgcagccccaattgccaatactaaagcaaaaaagccaatcatcacatataccgttttacgtttgttctgttgaatttgttcaaataacattcccaatcacaccctattcaaaggaaactttaggtgctgctttttcctcaactggcgtttctaagtaagctgtcttttggaaattgtgagcacctgccaaaatattaccagggaaagtttgaatttggttgttgtaacgggtagcacttgagttaaacaattgacgtgcatacgcaattttattttccgtattcgtcaattcttccattaacttcgtaaattctgcgtccgcttttaaatctggatagctttctgacaaggcgaaaacgcttttcaatgaatccgttaattgattagaagccgccattgttgcttgccgattatcagctggcatttcaaccaattgattccgcatcttgatgactttttccaacgtgtcttgttcatgcttagcataacctttcacggtcgatactaagtttggaatcaagtcattccgccgtttgagttgtacatcgatttggctccatgcttcatctgtccagttccgactcttgaccatgttattgtaggtgctgatatagaagccaaccgcgccaaccactaacaaaataatgataataataaaccacaacatacgcgtatcctcttttctttaatgttgtcttcatattatcagactcgctacaacaaataaagaataggttgccaaccttaacaaaaccttggtttgacataaatggtaaaattaaagagttaccaattttgggagggatacttgcatgtttactgcacagccagcaattgcgaatgttgatttaactgcaccacggatgattgtcgatgaccctcggattcccatgagttatcaggcactttgtcaaacaaccaatggcggttttttgactaactttagccttcctacgagtgagccaacaagtgatggtctcgccgacgttgagtgtcattatttagctgggattgctcacaacggtgaagcagtcatccaagcccccgacttgcccgattacttagtcccttttagtcagcatcaacagcagtactttgtatttgattgccaacaagcctcagctgaaccaccgattcgctacatagatactgaggtcgatcaatggttaaccgttgctgattcgctggatagttttctcgaacaattaggtcccaaagtaattgatctaaatccagataatgagttaacccctttgcagcgtaaccattacttgttagtggcacagggagcacagctagacactttgctagcccgttatgaagccgatgctgataaagaatggctgtttgattggctactctattttgccgaacacggtacaccagcccaacaagcaagcgcattgactgcctacgacactcagcggttgtactttaaacgccagctgccacgagctaaagatgcgcaactgactgccctctttgaacaactcccacacttaaaagacgcctaccacgcacatcagcaagcgtggtcgccgctttaactttttagaatcgagatgatgacaccatgttgactaacattcgtcaacgtttattcagacgccgcgcacaatgggaacagaacctcgtcgttttatggtttggtaatttcatggccggggttgcttttagtttgattatgccatttatgtcgttatacattgacacacttggcaactttacaacggcccaactgagtttatggagtggggtgacctattctattaccttcttggttaccgctctgatttcaccatggtggggcaaaattgctgaccgccgtggtcgcaaattaatgttactccgcgcctcattaggactagcgattgtcctgggtgcgatgggcttagtccaaaatatttatgaattaattggtttgcgactattacaaggcttcttctcgggttatatcagtaattcaaacgccttaattgccacttcagcaccacaagaaaaaagtggtcaagctttaggcaccctgaccaccggaagtgtttccggaaccttattaggcccgttgttgggtgggattatcgcccaagcaaccggctatcgaacaaccttcttcattaccggtaccatcttgttcatcgtctttatcctctgtctggttttcgttcacgaagacttcacgccagtagaaaaaggcgatcaagtacccggtcggcaactgattcatgaattgaaatacccgcatttaattatcggcatgttcgtcaccacaatgattattcaagcctccaacaactcaattagcccgctgttgagtttatatgtccgtcaattaatgcatcatggcaataacgtagcgttagtcagcggagttgtcgcggctactccagggatcgcaaccttaattgccgcgccgcgttttggtgcacttggcgatcggatcggttccgagaaaattttactcggtggcttgatcttcgccgtcttcgtttacgttccgcaagctttcgttcaaaatgtttggcaactcggtgccctgcgtctgctggttggggtcgccgatgccgcattgttaccgcaagttcaaacgattcttgcgaagtactcaccccatagttccgccgggcggattttcagttataaccaatccttccaagcaatggggaatgtcgccggacctttaattggttccagcgtttctggcctattcggttacagcggggttttcctatcgacaaccgttttagtaatcgtcaacctcttctgggtgcgtcagaatacaaaagtcttacgcgaagaacatgaaatacaaaaataatacaaaaaagtggtgtcgctcattttcagagcgacaccacttttttgttgaaacgtgctttttgtggcatatttctgcgcttaacagaatttgccaaatcggtgattacaatcgccaattcgtcaaatccagttaatgctcaaaatataagcgccacaaacgcactctattttttggtaaacgtcagtttatctaaccagtcccggttatgtttaatacagaaatagccgataatggcgattaaacatgatcccaagacatccgctagtaagtcccccatcgtgtctaacaaggctgcttggcctaataaaaggtgaccttttgccatataacgttgcatgtttaagcctaacaaactatcgccggtaaattcatagaattcccacaacacaccaatcgtactcccaaacgttgccgcaaacaaactcatgagtaaggctgaaatggtttgacggagttgttttgaaatcaatacgttaaagaccgtataccctaagcccgccaataacccggcactcaagacatgcaagaatttatcccagtagtataagcgactataaaaatgtaatcccgtccccaataaaatcgaacagtatacaaagattaaataaactgcatatagaatctctggaaaccggtatggcataaagcgttcaatgataataggtaaggtcgcaatcaccaggcctgcaaccacttgtaaaacggcaaaagacaatgttccgttgtctttggggttagtcagcatttgttctaagttcaaaatggggcctcctaaataatgatatctgcttaacatgctatcatgcttagcgataccatgcaaacgggaaccgtgatgcgtttgattttcatcacttcttcatatattattcacccgtaattggtttatctactgtataatatagacatagcaacgtaaaaagagaaggaattctaatgaaaattttaatggtagaagataacaaatccgtatcagaaatgatgagtatgtttttccaaaaagaagcttgggatgcccatttcgcttacgacggcaatgaagcagtggaagcctttagtgtcgatccagagagttgggacattatcacgcttgatttaaatttaccgggtttagacggaatgcaagtcgcccaaaaaatccgcgagttgtcgaagacagtaccaattattatgttgacggcgcgcgattctgaaagtgatcaagtgcttggccttgaactcggtgctgatgattatgtgacaaaaccctttagtccaatcacactgattgcacggattaaagccttacatcgccgtgctgagttgattgatgaacaagtcgaagcagctgaagaaaacttacaacaagcggctgaaaattcagattttgatgtacaaacaacacactttaagttgagttctaaaacgcgtgagacttatttattggacaaaccaattttagatttaacgccaaaagaattcgatttattgaagacgttagctaaaaatccccgtcaagttttctcacgggaacaattattagaacttgtgtgggattaccaatacttcggtgacgaacgaacagttgatgcgcatatcaagaagttacgtcaaaagattgaaaaagtaggaccacaagtgattcagaccgtttggggtgtcggttataaatttgatgattcagacgcagcgcgcgaatgaagcttatttatcaatggatgttggcatttttcggcgtcattatgacgaccattattattgtggggattgcgtttacgcaatattcgacaaggaccgcttatgagagcacctgggatcaactagaaggttacgcggatgtgattgaacgtgaagctttcaaacaggggtctcaagcggccttgtcgacccaattcattattgatagtcaacaaatcctttcccaacaacacgttgggtttaatttctttaacgccgaaaacgagatggtgtatcctaccccggatcctaaagtttcggtcaagaaacaatattggaaacatttaaagaatggccagattcaacggctgagcttaagtcgtgattcgcaccaagtgaataacaataagcaagaacagttagtggtcttcaaacccgttttttacaataacaaactgatttacgtgattggggtggcagcaccactacaaaccgttaaatctggtttgacaacgatgcgcaagaacctcttgattgcctttttactatcgacaatcggtgggattctgttgagttacgtcttagcacggtaccaaatttatcggattaatcgcttacgaaatgcgacccacctagttgctgagggggactttaatgttcagattaagaatccgggtaaagatgaattggatgatttggccaccgattttaatgagatggtgcattcgttgaatgaatctgaagaggaaattaagcgtcaagaagatcgccggcggcaattcatggccgacgctgctcacgaaatgcggacgcctttaacgaccgttaagggtctgttagaagggttgcaatatgatgcgattccagaagagatgcgcgccaagagtatttcattaatgcaaaatgaaaccaaccgactcattcgcttagtcaacgagaacctggattatgaaaagattcggactaaccaaattaaattgaacccgcaaacgtttaatgcggtggaagctatccagaatattcaagagcaactcgagaagaaggcgactgaagccggtgatacgctcatcttggacgcccaagagaatgtcccaatctatgccgactatgaccgttttgtccaagtgatgtttaacatcatgcaaaatgccattcagtttacagaaaatgggcaaattacggtgactgcggaagctggtttccacgaaacaatcttaacgattagcgataccggtatcggaatgacggacgaacaagtcaaaaatatttgggaacggtattacaaagcagatccatcacgtaagaataccaaatatggtgaatctggtttagggttggcgattgtccaccaactcgtccagttacattatgggacgattgaggtccaaagtattcctgaacaagggaccacttttaccttaactttcccagatgaaacgattgtgacaagtgaaagctaaaccaatttaaataggcgtcacgacaaggattaaattgtcgtgacgcctatttttttagattaaatatgcaattgcgtttgagctggttgggtttcactgatgatttcgccagcgtgcattgagagggtaacagcggcgcgcttgttgagagcctcgtagaagttgtcgctatccattagaatcaggtgggcgggtttacccacttcgagaccatattggtcaaggacgtgcattgcacgagcaccattgtaagtaatgaagcgataggcattcatgatttcagtatggcccatgatttgggttgccagtaggccactatacaacacatcaagcatgttgccatcgcccattgggtaccatggatcttgaatatcatcttcaccaaaagcgacgtttagcccgttggcagtcagttcttttacgcgcgtcaaaccacggcgcttcggataagtgtcaaaacggccaccgagaaataggttgacaagtgggttggcgatgaagtttaaatccgccatttttaacagccgcatcaatttgtacatataggcatcgttgtaacagcccatggcagttgtgtgtgaagccgtcactttgtctttcatccccgtttcaagggcgagagtcgcgactgtttcaagactacgtgaattgggatcatcaatttcatcggtatgtgcgtcgaatagtaaatcatattcttgagcgagttcaaaagcaaacttcaaggattcgacggcatattcgcgattaaattcgaaatgtggaatagcaccgattgcatcaacccctaattgggcagctttggtcattaatgctttgccatttggaaaagaaagaatcccttcttgaggaaaggctaccagttgcaacgtcatccaatccttgacttcttcgcgaacctcgattaaggctttgagcgcaactaagtctggatcagtcacgtcaacgtgtgagcggacgaattgaatcccatggctggcttgtaatttcagtgcttgaattgcgcggtgtttgacgtcgtcgtgggttaaatcctttttgcgttcggaccaaatccgaatgccatcaaacaaggttccagattcattccattcaggctggccggcggtgagagttgaatcgagatggacgtgaggatcaacaaatggcggtaatgccaattgaccatgtccgtcgatgacttgctcattaggatgcggtattagctgtgcctcaattgctgtaatgatcccgttttcaattctgattgactgcaatgattcttgattctcaatgtgcacgttttgaatgagcattttatccaacctcgctttttttattagtgagtataacaatcatgagttgactttggcaagtaagtttaatacaatgcttataaatataaatccttttaagggcagtccagtgaggctgacaaaggagcggttaacaagtacattagtggacctgctctgtctaggagtaggtctttttttaatgcaattaaccaagtggagggtatcaaaatgacaaagcaacaaacaattcatgcagtatccaaggacgcacgaacgatgggcagttgggatttgttcgcaacttggattggtgcaaatgcgaataacggcacttggtttatcggcggcattattgcggcaactggcttgattcaagggtctacgttgttactagttgttggctgtttatcgtacgtcttgcttgcactggcctcctacatggggtatcaaactggtgtgggggcgatggggctaacgcgggcctcatttggcgtgaagggatccgtcttgccatcgattatcaatgtggtacaattcatcggttgggctgcggtgaatacgtatattgcagcaacttcagtgagcttcatcatcaaggaaatcatgggctggtcaggcaacgatgcagccactaaccggatgagcttgattgttgggattctaattatgtctgtcctgcatttaatcagtatttcgctcggtgaaaaatccgtccgctggattgaacgaattggcatcatcttagtgattatcttagtcacttgggaatcaatcattgtcttcaaaatggtaccgttcaaagacttagtggcgtggcgaccagccagcaacttgcggcttgaatttgggaaggcggtcgatatcctagcagcgtttaaccttgcatgggtaaccgctgctgcggacttcagtcgtttttcaaagaacaagaaagcagccacaggctattcattcttaggcgccaatattggcctgttctggtttgctttcatcgggttaacggcgacaattgccacagcgattacgttaaatcattttgacccgaacaacgcggatccaagcaccattgcggccaaattagggttaggtgttttagtgttattagtgatcgtgattaccagtacgacagctaatgcggtgaatctaatggctgcgggatcggctttaaccaatatttttccgaaatttaaattaacgccggcattgtgggtcgtgacgttattggcaacggtgatgacctttatcccggtctatgttgcctcatttttaaccactttcgaaaccttccttgatagtattgggatgttcttaggacctgaaatcgcagttttcttggtggattacttcattattagacggcggcactacaatgttggtgcgctcaatgaagttgctggaccatactggtacaccaaaggatatcatctgacagccatgattgcatgggtcattggggtggtcagctacttggtcttaaatcaattcgcgattattcacgcttatacgggggcaacgtttatcgcaatggggctgacagcacttgtttattggttaatgattcaaagaaaagaaaagacaatttaagggaactaaaaaaacgtcttaattaaggcgttttttttaatttttaccacagagttcatataattttcatactttagttttacactatctttattaggaggtgggtcatgttcttcattaaatcaattccagctaatattcggtattatttacgccaatctttgttaatctatctcgtggattgcctctttttaggcgtcatgctgattgcgctgagcttgatcagtttagaacgacatgacctcaaccagttgaaaaagcaattagccaactttaacacaactaaagaggggactaaccccctgacacatctggttcaaagtaaagaagtcttactgggacgctatcaatttatcgcggtagtgctgactatcgttatcgcacttgtgattggtattttgacttggcaagcgtttaagaagatgcgtcaggatatcgatactttcactagtgcgaattggtcgcgacatacaattgtcaattattatacgttaacggcgctttgcttactaatcagcgcaagcgtgacagtgattttaggttggttattagtcaattcctactattggcgcggattagagctgattaatcaacagtggctacaaaagccgttgcgaccaatacaaggtccccgagcatttcaaccgttatttaaaaatcatctgactgactttagtagtcattcgttattgaatccgattttgcatgagagcaccaagcagaatttaaccaatcaagtattcgcccgactatgggcaccatttatcagtctaattgcaccagtctacattattggttggtgccaagttactcgctttaggaaaatgagaaaggcgtgattgaaatgctaaataaacaacccttagcacttggacaggtctattttagtcaaccggagatgattcagcagagccttgaatcacctgaacccccatatgtcattgattatgaggcgcctaagattctaccctttatgtccggttgggataacttgttgcttcctaaaaagcagcttgcaccaacgttaaaaatgttgattgaacagcatttaaagcgcagtcggagtttattgggcaccgaattaccgccagtcgatcagttctggattcaattgattcgcggtttagcaagccaccagcaactcgtggtggtcaagcatttcttagatgaacttccaccaacggatgctcgccaattattaaatgatgtcagagcggtagcagcgcagtttcaaattatcgtaatcatgacaacgactcaggaatccgtttttaatagttttcaatcgcaggtgattagctaacgtcaaaaaaacgcaaggacaatatatgttgtccttgcgtttttttttgacgattattccgcatcgttagttgctgttgcatcagactcttttttcagggcctttgattttggcacttccgtgaggcttgattgatcatccgctaattctggagcatcggttttaaagagcccaacagtcgattgatcaccattttgcgagaataaactggttgaattagcccctaatttattttgaatatcgacaagctgttgatagccagtcagatagttacaatcggcagggttcactggtttaaaaccttgtggtgtatagaaacgtaataggttcttttcgttaactgaatccgacaaactcaattcgcggttcacttgtttctgccaaacagcgacttgtttttgcaacttagctgttggttcagttacttctgtcccatcctgattattgtagatggtgccatcgagcactgtgtaatcaggggtgacaaagttatggtttcggaaagccacgacttgatcatgttgtggtgataataaatcggtgccgaattggacgtaatttttattatcaatcccgagtaagtgaagcattgttggtaacgcatcgatttcgccaccatattgtttttggataccgccttttaaaccgttcatgtgaatcatgtaaggcacacgctgcagttgggcgttatcgtagtcggtccacgtttctgggtcgcggcctagtacactgagtaaggccttattatcagaattcgaaagaccgtagtgatcaccatagaggacaatcattgaattatcatagagcccagatgctttaagataattgaagaactcttctaaggattggtcaagataatgggcggtcgcaaaatagttgttgaccgctgtattatcagttgtggcacgggggaagtcaccgtctttttcgggtaatgggaatggaaaatggttggtgacggtgatgaatttcgtgtagaacggctgttgtagctgttcgagatacttaatcgattcaccgaataataatttgtccttcaagccgtattgtaagacgttatcaggatcggtgttaaagtaggaagaatcgaagaagtagttgtagccgaagttcttgtagacgttattgcggttccagaaggtgcccacattaccatggaaaacggcactcgtatagtcaccgttttgcttgaggattgatggggcagcttggaaggtgttatccgaaccaagcgttgtaaagactgagccttgtggtagaccgtagacgccggtttccatcatgttttcggcatcactggttttaccttggccaacttgatggaagaagttttcaaaacctaatgtattttgatcatgatagaggctatttaaaaatggcgttacttcgcggccttcgaacttaaagtcgattaggaattgttgaaaactctctaaatgaatgacaatgacgttcttgcccttggcaacgcctgcgtattcagcgttcggtgcagcgtaatgctctttcataaagtcgagcaccggatctaagtcgtaactctcagcctgggcgcgcacttgattattctgagtagtcttgaaagcatcgtagacggtgaaggtgtcgatgccgaggtacttaacgatgtagttccgatcaaacgtccgtgataaaatttgaggtcggctgatttcacttaagccaaggttgatgccaaataataagacggccaatgaggtaatactgaaggcccaccgccgattaaatgcgtgtttgtcgatcttgatgaccttggttaaaatcagcaaggctaagacgataatatcaatccaatacagcgcatcatgccagttcatgagggccagtgaacttttgctgagcccagccgaaacttttgaataccctaagatggtgttgatggtcatgtaatcggtgaattgccggtaatagatgacattaaaatataaaagagcggtgttggcggcatagataatcaagctcaaccaataactgagatgcggctggcgaacataaagaatgatgccgaataaaaggagcgtcgtcgcgaccggattaaagattaaaatagcaatttgtaagaagccactagctgcgaggttaaaatcggtgaagtacccgaataacgtttttagccaaaataaaaagactaacaaactcatgaagcctaatctcgtggataggaatgatttaatttttgtgagtttcaaataatgtgacatcctttcaaaaaacagaactaaaagagcgctaatgccttattttaacccgagggcggcattagcgcaaatagcagtttaaagtttaaacagaaacttaacgtttcgcgggccgcatgatggcatcgtactttggattcagttgatctggcgccaaaacatgttgataaacggcttgtaattcatggccgacttctgtaatactcttagactgcgcagtttggtagccttgagctgttaaatcgggaacggcattagtgaccatcgcttggatgagttgactgaattctgcgttagtgtgacccatgtagcagttttgttgatcggcaagccagccatggtaaaccggaatatcgcgcaccaatactttttgatgacttgcaagggcttctaagacgacaatcccttcagtctcttcataagaagggaagaaaaataagtcagcattggcatacgcgccttcgataatatcgcctttgatataaccaggaaagatgacgttgtcgggatgatcctgtttgacaatccggcgaatattggctggaatactgtacatgggtacatctccaaaccagataaagatgtattcgggtagacctttggcgatttcgacaaaatcgagaagccctttgcgtttaaagaagaggccgacgcagataatcactttttgatcaggctttaaatggaagaaattccgaaaagcagcttctttagctggtgtggcttgatacttagctaaatcaatgccgtttgaaatgggagcgatagggttggttagaccatagctttccaataatgattttgaataaggggtgggggtaattaagtggtcggcttgttgatagaggctaacgaggtaccgtttaacaaatggagcgagttgattggaaccaacaaaggagttgcgaaaatcttcttcggtcgaatgtgcatgataaatgacgggtttccccattttacgagccttcttgatgacactgcggcttttgagtccgtatgtattgatatgtaagatatcgtaatcttgatcattcggatcaagcgtatagtcaatccccatttcggttaacgcgcgtttttgatgatccaacgcccgcccaattccagatttagcgagtagtttttcactttcaaaatataatagaactttcataaaaggctcctgtttcaagttatagtaatttctattatagcatagcacagtaggcacacatcgggctaaagttgggcagtcgatacctaatagtttaagattcactttagtcgagtaattaagcgttatttattgaaaaaaaacagctataatggacttaattactcattgaataatgaacagataggttaaattagtggaataagtgaggttggttttttggtatttcttgggcgtatttatgaacaatggatcctcccttggggggaacagtataatcatttaccactcatcaaattgacggtggagagtttagataagacgattttgtattgtttggtttttatcgtgtgccggttggggtacttattaatgaaacgacgcaaaatacagcttcttccagaactgaaactattgttatttgtgttttatattgccttattggtctcattaacggttttacggcatatttattatccgtggcaaatgcagttccatttgcaacgaccacttagccaaattaatttgacaccgtttgttgagactttcaagttacggcaagcgcccgcccagattgattattggtataacttctacgggaacattgcgtggtttatcccgtttggtttattgcgatggtcattgacacagcgcaaaggggattggttgattacgattattgaaggggctctgttatccctgtgtattgaatccgcccagtttgttttagggactggcatggcagatattgatgatctcatgtttaatacattaggggtgatgattggcgtcctgttatatcaaggcctacaacatgcaaagcgaaaacattaaggttgtcaacggtaagaaaacgcttatcgttgattttttttactaaaaaaacgcttttttacgtaaaatttacgtaagcgcaatcacgactgggacagttgcttacatgacggtagtgaaggctagtaacgattgactggtgccgttttcctactagccagcggatataaaactatgtataatggattcttgtactttagagaagaagaggaatttataaatggctattttaattgcattaatccctgcacttgcatggggtagtatcgggttagtgagtggcaaacttggcgggaatgcctatcaacaaaccttaggaatgacaattggtgcgctggtttttggaatcggtacctttttagtattacaacccgctttaaacttacggattatggtaatcggtatcatttccggtttattctggagcattggtcaaggacaacagttccaatcaatgcaagcgatgggtgtttctaagacagtcccattatcaaccgggatgcaattgattgtaaacactttagcaggtgctttgttattccatgaatggaagacaatgcacgattacatcttcgggattactgcattagtgatcttaatcgctggtgcaacgttaacttcaatgaaggatccgaagagcagtgttgctgctaaagaagatacacaatttgcacgtggttttagagcattaatcttatcaacaatcggttatggtggttacacaatcatcgttaactggtcacacattggcgcaacatcaattgttttaccacaagcaattgggatgttcgtcggtgctgcaatctttgccggtgttggcattgggacagcagtcttcaataagaaaacagtactcaacattagtactggtttattatggggtcttgggaacttatttatgttgatttcaatgaatgatattggtctagcaattagctattcattatcacaatgtggcattatcatctcaacaatcggtagtatttacctattgggtgaacaaaaaacgaaaaaagaaatggtttacgtcactcttggctgtttattagtcattgtcggtggggtcaccctcggtatgatgaagtaagcaacttactaataagtcacctagacaaattgtctgggtggcttattttgtttagagtgtgtattattctatagaaaaggcaaaagaagtgagtcagatgaagagaacaaataaaacagctgtcagttactatttattgagtgtgctagttcccatgttattaatggtggggctatatgcaatgctccaaattgtgccatttggacggcataatttattgattagtgatctcggtacccaatatatgccctttttggcagagtttaaacggcaaatggcccagacgaatttcagtacgtattcattttcactgggtggcgatatattaccgctagcggcttattatttaatccggccaaagtcgtttccgttgtctcttcgtcatctgattcccctcatttctacttaacaaatagtcctagttcctctagtataaacaacctgcaaaggggacaacaagtttattttctattttgattcaattcgttcactaagcgcttattttgatagcgcgtgtagtaataaaaaataatcacgtgcattacgaatgttaataacgacgtccctaataaatacggtgaaacaacatcaaataacgttgtcgaatagagcctcaaagcgagtatttgaaacccaatattactaatagtactaatcaaaacattccacggcgcaccgaacgtcgaatagcgccataagtatgaataaatgacgccaaacacaatgccaatcaacacgcctaggctaactaatcgccaagcagccagcgcttcgccccgcgttagcgttgtgacaacagtgagccacataatcgccattaatgccacttgattaaagtctttgcggatttgcttcatcattttaaccactcctttatttgcttggcataataccgactaacaatatactgtcttccagattgcgtatagaccaccaatcgcgcatttgaacccaccgcaaaattggcaacttgctgcagatttaaaatcgttgtgttattaattctcagaaaaccgttctgcgaaaacggggctaattattttaaattactagggtagtaatagctattgccatcgattgtcgccaccttcgccaaatgtccaaaggccgtaaaactttcaattgccgttaatgatatgttttgtaatcgatctgttcgcgcatctcgcacctgaatcgattgatcaaaggttagcttcttaaaagcagattcaaccgttgcttgattctgtggttgactgtgaacgacaatcgtatcttgtgcacactttgaatcccaattaaatataattttcattaactcgcctcctctacaaacctaaagatagcagaagatctcgcttaattcgatgactatttgttttgttgcaagctgctctctcttgttgcatataaaaagcctcattcaacaatgaggccttttatgcctatctctatttgtgatacggacttccttgattaatcataaacgcccggtaaatctgttctgtcaatactaagcgcatcaattggtggggtagtgtgagcttgccaaatgaaagtgcatcattggcgcgtttgttaaccgcatcgctagtcccgagtgacccgccgatgacaaatgtgatatctgatttaccataggtcgccaaatcttgaatttcctttgcgaattcttctgaggcacgttgtttgccttgaatcgccaggacaatcacatgttccttatctttaatcttgttgagaattcgttcgccttctttgtctttgacgttagtcatttcagcgtcacttaatgattcgggcgctttttcatccgcgacttcaatcatttcgaacttacagaacttactgagccgtttcgcatattccgcgatccccgcttttaaatacttttcctttaatttaccaactgtgattactttaatgttcataaatagcctcctactgttacttacattttaggggaaaacaatgcagaaaaaaagctattcacagtaattcaccggaaagtactgcttatccacaaaagttgtccacatatgcacaagtgttcgtcccaaatatggtatctcgaatttttcttgatactaaataaccgacacctaaattttttcgttaaatttaataaaaaagttatccacccttttttgattgttcgttctcaaattatccggttacaaatccttttatatcagcgttattctggtgttataataattttaaaaaagttatccaccgcctgttaatttttttgtggataactaaaaagaccttttaaccgtgttatacccacaatccacagacttatccacagacgctcggatttcttcccgggttactatccacattgacatttttaaaacttaacattcctgccactttagtctgaatttaaccaaaataaaaaagccgtcaacatctaattgatgctggcggctttaatttattttgctgccgttgtactatctgttgatgctgcttcagtcaacttcactgttgatttcttcaattcaccattatgataatactgaatttcaaccgtactattcatatcgtaactgtaaagtgtcgtgtgtaaatcagcaacacttgtgacatccttgccacctaaaccaacaatgacgtcgtatttactaatccctgccttcttagcaactgagttggcattgactgatgcaacaactaccccactcttcacagaggttggtaatttcaagactgatgattgttgcgttgatgaaacattcgtcaaatcgatgacgctaatcccaagcgctggtcgaacaactttcccatttgcaaccaattggttaataattttgaccacttcgttacttggaatggcaaagcccatcccttcaaccgttgtgctcccgttagaagctaacttcattgaattgatcccgatgacttgtcctgcaaggttaactagcggaccacctgaattcccagggttaatcgctgtatcagtttgaataacggttgcttggccagtcgcttgaccggttgtttcatccgtcacatcaatcgtccgtttctttgctgaaataatcccttgggtaacagaagtagcatattctgagcctaaaggcgaaccaatcgcgagcactgattcaccaggtttaatgctgtcagaatcaccaaacgttgcggtcttcgtcactttggcactatcaatctttaaaacggctaaatcagaaacggcatccgttccgactaagctagcatcaatttttgtgccatcactaaggatgacttccaacttatctgagccagaaacaacgtgattgttcgtgacaatgtaggctttaccatctttcttttcgtagattaaacctgagccttcactcgattcttcaagctcactactactactttttttattggtactatccgcgccaaagagcgcactcaaatcgcctgaattatcttgttgtttttgcaagttaacaactgacacaaccgctttgttgaccttattaaaggcagttgttgtttgtgaagatgagttgactttgatattactaattttagtggcacctgctttagttggtacttgggcagtgcttgagacagtgttacttcccatctttgaaccggcataaccagcaacgccaccaccgattagtgctgcgataacggcaacaacagccgttttcattaatcctgaattctgattcatactaattcacccaaactttctaataaattctgtttattgattatctccatcatagaatggaaatttgaaaaaattatgaacaagttacgaatattaaattgtttttctaatccgcattttagcgaacttatttcgcaaaaacaactaaaatgtcttctattcagtctaattacacggcaaacaatggatcagcaactgccggatcagtatctagaatttcaaagtctgttcccaccccataatcatgttcctttaagatcgacgcaaccgtcaaatgagccagttccttcatgttattttcttgactcaagtggcctaggaaaacgcgtttagtctggttccccataaacgacatcaaagcggatgccccatcttcattcgataaatggccggtatcactgagaatccgttgtttcaatgaccaaggatattttcccatccgaagcatctctaaatcgtggttgcattccactaaataagcatccgcattttcaattgtcccacgcacttgatcagagacataacccgtatcggtcaggattgcaaaggcacggttattatgatggaattggtagaattgggcagcagccgcatcatgtgacaccccataactttcaatatctaaatcaccaactgacaaggtactacccatttcaaaaatgtgcttgtgttcagcaggcacttcaccaataatcgaagccatcgcatcccatgttggttgatttgcgtacacgtctattccgtatcgccgggccaaaacaccgacaccactactatgatcgcgatgctcatgggtcactaataaactgtccacatctttaagatcacggccaatactatgcattaaatcttgcacgcgtttcccactcattcctgcatcgactaacactttatgattaggtgtttcaatatacgttgtgttgccagaactactgcttgcgagcacgctgacttgcattgcgtctttttctaccatgttttgctctatccccttggtctctttctaaaacaactaaatttcactacggttcttcatcagcgcaccggtaaaggcgctaatccgcttaacgacgacactcttagaattcttattctcaatggccacttgccaagctggcacgtacaccgtactactattggcgtccaacaaagcactgtatccgagtttcacccacataatgcgtgagttattcggaatctcattatctgtatataaatcaatgaccgcgtcttgagcagtcaccttcgtactttctttttcacgcaaaacttgaatcttattcgtgtaagtttgcgtgtaatgactaatctgcccgtcttctaatataaaaatcaactgaccatgttcatccatgatctgcccgcctgggactttttgcacatatacgacttgttgatcactcgataatgcgtgtgaatagcggtagtcctccgcttgaatcacgttgtctggttccttcataaaggccgccacggctaagctttggttcccttttttgtaagtcagtggtttatccaattcactcgtcagtgtcatgcgcgctttatcaaacgaaacagtttgaccggttagtttggcactcgccgtttctaataatgtctgatctttttgtcggctggctaaataataaccatccattcggcgcttagagagtttcttcactgaaatttgatcgtcttttaaagccttcataatctggctagtctgtgaaccactagtaatcgccgtcgacgttattgtctgactgcctttcagcgaggcaaatagatagatatccagcgcaataaaaatggcgataaaaatcatttcaattctgcgaaaatccattcatctaactcccttcggttaattcagctttttgcgccatcaatgcggataagctacgccaaacccctttatactgtacaaagtaggttggatttaaatcaatcacttgttcgttactggtttctttggtccattcataaccgacttgcacgttttccacattttctagcaagaaaccattacttgtcaattgattcaaaacagactcggtacttggcaatgtgacttgcttgtcttcagcaggaacgggtacttgcaaactataatttgaaaaatcaatcttttgaccagttggtaagaattgtactttcacgctcccaaagttagtctgataaaagactgggaatccttcaacgtaggtccgataagcagtcgaattcgttgctttatcataactatagaaacgcatccctgaaagggcattacctgtctttaaaagcgcatcaaaactggcttcaaaactctttgttaatgtgcttggtgatttctcattttcatacttcacaaacgaaatttcaccagtatcatggttgatcgttaggcgtttatacaaattactgtccgtcccatccgtataaatcgcactattgccttgttctttcgtatcaatattatccgtattttgttgattcaacagcgttgtgatgtaataattttcgggttgttgattaactaaataactataaggcaacaacgtttgatccgctgccacatagagtaatggcttgtgattcaacattttttcggtcactttcaaatgcacatcggcatttttaagcacctttttcacacgagcttgtgaaaaaacattgagtgtcgtttggtacacttgatgactttgatcattcatcaaccacaacttaggctgtgtgcccaacgtgattcgaatccgattgaatgtcacgttttgacctaaattattattctgataactgaagacctttttaaaaatagcgtacgaaatattatcaggatataaaagggtcaatgtatgatcctcactaattgcctgataataatcgtcttcgcttagcttaacttgcttaaactgtgccgacttggcaagctttaaagtcgctttaaactgtggaatcaaactctcttttgagttataaatcaactgactctgattgtctgtccgccacaatagttgcgtcggcaagaagatatcaccgatttttcgttctgtcttacgacttgttgacttagtggtagtttgactgtccgtttggcgctcataatgcgcgttactggtccagattagccatgatagcccgatactgacgataatggcagcaatcagtataacgcgcattaaaaagttattaaatcgcatcccaatcacctccatcagaatcaattggttcatatggcaacgaaatgtagaatgtcgagcctttaccttcttggctatcaacccaaacacgcccacgatgcgcttcgatcacttctttagaaattgccaagcctaaaccagtcccgccttgtttacgagaacgggccttatcaacccggtagaagcgatcaaagatcttaccaaggtctttccgtggaatccctaatccttgatcagagatgcttaaaatcacgtgacgatgtgtttccaataagcgacacgtaatcacgccaccatctggtgaatatttaatcgcattattcatgatattatcgatcacctgcataaatttatcggtatcaatttcaacccataaatcccgcttagtgaagtctcgtgtaatactgtacttcttattcggatcatctgttggtagtttgcccgcgctggttgtcagtttaggcaaatcatcttcgtgctcttgatcccgcttgatcatcatgtcaaaccgatccagtgcatacccaaagaactcgtttaaattaacatattcgagattcatctttgccgttccttgatccattcgtgacaaactcaatagatcgttaatcattcgaatcatccgatcagtttcttcttgggtcacctttaagaaattgggcgctagctctggatcttgccatgcgccatcattcagcgcttcaatatagctccgcacgcttgttaatggcgtccgcaattcgtgagacacattcgaaacgaattcgcgctgttcttgttcattcttttgttgttcggtgacatcgtggagcacacaaactaaaccggtgatatagccggtttctttttgaattaatgaaaaatcaacatgcaagattaagtcgtgatcttgttgttctgagaaatccaagaccatttcctgttgcgtttctaatagatcgcgcaaagaatattcatcactgattcgtaaaactttaagcaatgactggcccagtaactcatcgcgtgtcacatttaaaaaatcttggccagtttcattgataatcgtgatattgcctcgtcgatcagtcgcaatgaccccatcagtcatatgactgagcacactatcaagtcgccgtcgttccgactctgacgcttcttgcgcctcttcaacccggactgataagttattgaccgcaatcgcgagttgccccagttcatcttgaccataaatcttaacttgaccagagtaatcccctcgcgccatttgaatcgcttgtttcttcatttcatcaattggtcgggtaattgcccgggaaataacaatcgataatgccatccctaataaaccagcgactaaagacgaggttaagaaaatgacggtaatcgacgaaatcctcttgtaaacatcttccatactagcccgaatataaacggcgcccacaacggcattactatccccacttgggttcgtcaacggttggatcgctgtataatagctccctagactctcattgtatgccacttcttgttcggtatgcccagagtaaataacctgtttcacccgtgggttacgcgtcttttgaccaacggtgctttgattattcaagttcgtgacacctcgaatggtgcccttattatcgacaacctgaatttcggcagaattgcccatatcgccaataatctctttaatattcttgttcgcattaccactattattcagtaactcattactgagttggttttgaatatagggtgtcacttgtaaggattgcttaaaatcacgcacattctgatattccagttgcttcacaaaagaagcgccgataacttccaacgttaccagcagcaacaatacgaacacaatggcaattttaaaatgaatcgattgtagcaaccgaattttcttattcatgcggcaaatttactcctgctcaggatttcttaagtaataaccaacaccccggcgtgtcactaaccattctgggtggctggggttgtcttcaattttttcacgtaaacggcggaccgtcacatcgactgtccggacatcaccgaagtaatcatacccccaaaccgtttgtaataagtgttcacgggtcatcacttggccgatatgcttggctaaataatgtaacaattcaaattcacgatgcgttaattcaatcttgtcgccccgttttgacacaatataagcatcaggatggatcgttaaatccccgatgttaatctcgtgattttcttcattcgcttctttatctgattgactcgttgtaccttgccggcgtaggttagccttaactcgcgccactaattctcgatttgagaatggtttcgtcacataatcatcggcaccgagttcgaggccaatcactttatcgatttcagaatctttagccgtcaccataataattggcatatcatgcgatttacgcacttggcgggccacttctagcccatcaatcttcggtaacatcagatctaatagaattaaatctgggacagcctcttcaacttgttgtaaggcttcttcaccatcataagccgtgtagacttcgtaaccctctttggttagattaaatttaacaatgtcagagatcggtttttcatcatcaacgactagtatttttttagccatgtgcggatcctccttgaatgtggatgctttgccttctattatactcattttcagaaggcaattcaaaattaggtcaattcctaccaactggattaacggcattgttaatccctataacgattaattcttacgcgctcagtaactttattcaaaaaaatacaaataactgtttacaaaagtttgtttaatatgctatgatatttaagtcgtaaggcgagacatcatatgggtggttagctcagctggcagagcaacggactcttaatccgtgggtccagggttcgatcccctgaccacccatcaagtatacatgataagtcgttatagaggtgcttaggcattgatatgacggcttttttatttcttcttagcagattagtattcacagtgaatacgacaaaccgtattcaaaaccgtattcacgtattcaacaaaaatcacgcacggggcatatacataacttactgcaggcggtcatattaatggccgtcttttaatttgggctaacttcattaaacaacggcctatattaaacatagaccgccaaggatcatactagcaactactagcattagtttccgtcgtaaatcgcgactgtattcattagataaggggatgtccccagttttggggatatgtttcaaacgagcccaattttggcttggttatattttttaatctagattatatttaggggtaacgtttcgttacgccattatgtttctatccaaaaacacttactcaaacttgagccaatctatattctaagttaataccgaacggacttttccgctaagttgatccatgaggaggctaagcgcatcccactggaaacatatgtccaaaattggccacatctaaaattaattagggcttaattttcagccatactaccccaccctcacacgcatataacgcatctcttcggagtcttgaccccttcccgttgtttgtctccccaagggattagcaaatcattttaaaaagggggggcaaacatgctttggtactgagccgaattttcggccaaccttttttagcccaacaggacgatacgttatagtagcttatttcatgttcgccaagttgtcggatatagaaaatccatcacatacaccaccactctaattcaggagagtggttctaaactaccgtttcggtacctcagattgcttccatgcaattagccgaaacccaaaatggattgggcaacatctcgttaaaatcaacggtatctaaagttaattagggccgaattttcggccgtactgtttctataattggctaagtatctgacgcaccatatcagtgcattagatgctgttgcaatatactaactcatctttaaggagtcgtcaattcggtgactccttctttagggcctctaaaatctctaaataaattaatgttaggttttgttaggttttatgtccaacaaaaaccaacattttctattctctttagggtgtctgatttgtacggatagaaataaaaaaagggcattttgtctacttttgtctagttatatttaacaccaaaggctactaccacgggtttaaagctaattcacgtaggtttacattggataaaccaataatggcttgtcctattcaattactaatccataaactagcctgcgaaattttgcgcaacctacttataaacaagcaactcttgattattatagctttcggcaaaagctaataacgccctattcttaaaccgattataactagacctgctataccccatcgtatccgctatatattgccttgttttatgactaccgtctaagtaacacatattaataatggatgcttgcgtgtcttccagttctcctacaaccgtttgaatacactttaaatcacgcttagcctgctcgtgtaagggatgactagtatttaccgtggctagccgtctaatcgtgccatagctctttaacagctttctggcgttgttgatacttgcttgttggtttattcggtcaatgatcatactgcttcactccttaagtattaattcaattttgatggcatcctaaatcaggactgcatccccgttatcaatgctccttgaatattaataagccttcactagggtaggactcggcaaactctagcaaagcctgtttcttatgcttcttgaatgatgatgctgttatacctagttcaccgcagatataagccatagttaatttaccagcacttaaatactgcatctttagcaattccctgttaattaccgttaacttacttaaagccacgtctatgtattctagggtctgccgtgcctcgagtgttttaaccgcccgtttctcggttgtattatcacttctaaaagactttggtgcatgactgtaagaaggacttcttaaactgctggtacttgttacaacgtgctttaaacgccaatattgtgttaataacttatctgcttgctgtctgctcttgtattcgtcaatatcaaagataaacaaggtaacacctccaaaatataaaaaagggatgcactatccacccatatactggcgataatgcatccctttggttttccaatcaggtattaaactactttgattttgtcggttcgttcaataagaaccactctatcattttgagttgtaacggttagacttccatagcttggtaactcgtattctttactctgctgttgatccgtaatgataattttaaccatcatatcacctctaaatatcaatctgctttaatgctgtcagtctttcgttcatatgccttgtatggttttctagtggcgtgatagcctccgttagctcatctttactggtagcaataaagtaaccatgcttattgccttgtcttagtccaccaactggcactgcatacttggttatcaatagattaatacaactatgagcaatgaattagttaaatatgatccagaactgaatacaattcctctgagaagatttactcctgtagaaatgaatcttttcttttcggttgtttctagaatgcgcgataaaggtgatgatactgttcggtttacttttgatcagttaaaagaattaagcgcgtataagccgaccgcaaataatcgatttattgatgacatacaaagtacatatcaaaaaatattaggtcttagatttggctctagaagtaaagatggacttgatagagaaatgtttgtcatgtttactcgatttgaaatcaagggttcggcagaagtcccttatgttgatattcaaatttaccccaaggcattgaaacttctaaataatcttgaaagctgggttcgatatgctttagcagagttcagagatttaaagagtagttatgcaaaaacgatgtttcgtctccttaaacaatttcgaactactggttatgcttatttttctaaaagtgatttttttgaattacttgatattccgcaaagctattggaataaacctgcaaacgttgaatccagagttattcagccaattaaagaagaactaactcctcttttcaggggtctagctattagaaaaaaatatggtaaaggccgtggcaagccggttattggttactcatttacctggaaatcagaaaaaaagaacgcagacgacttctcacaaggtcaatttcaagatgaacgtcaaaaactctttaacattcagcataatggtgaattaacagagcaggaaaaatggcgtgccattgacaaagttaaggggttgactttaggctccactgagaaacaagcattggctgagaaacaagcggaacacgataaaaaaataagagatcaagcaagaaaagaagcacttgctgaactccgaaaggggtttggaaatcatgcctaaaactattagagaacttgctgatgaattgggcgtttcaaagcaaagaattcaacaaattatcgccaaattatcggcaagtaaaacaccaaataaggaaggcaatagatacgttttaaacgcccaagatgtcaaaaatataaaggatttgatgggttttgataatgacaagtcatcgacaagtgaatcgacaaatagacttgtcgattatgatgtttacttagatgtgatagattccataaaagaaaaagatgaacagataaaaattttattagaagttcaaaaacaaacacaaaatcttctagatcagcaacaacggttagccttacaggacaaacaactgctcgaagaatacaaggcagaaattaaggacttgaaagccttaacgatggcaccacatgatgatggtgaaaaaaagatggcagcacaaaaacaaccggaaccagaacatagcactcctgattcgcaacctaaacctaaaaagtggtggcgttttggtaaatagttataactaaaaaataaaagaagactagttaaatggcggaagataaatttgaacaagctgtaattgacaagttaaagagcgaggggtgggattacctcagtgagtattctggtgtcacggttgatcggttatatgatcactggcgagatattctgaatgccaacaatcgtaaacgactagaagatacgccattatctgataatgagtttgaacaagtgaagttggaactcacgaagaataaaacgccgtatgatgcgcaactcatgttggcgggtgcgggtggtgttgggaccgtaccgttgaatcgtgatgatgggacgcagctagaacttgaaatattctatggtaatgaagtggctggtggacattcacgttatgaagtcgttaaccaaattacgtttacggatttagccacgagtctcagatctaagcgtcgaattgatatcatgttgctgattaacgggctacctgtggcccacattgaagaaaaagatgagtccttgcaaaaccaatggaatgcgtttgaacagttccaaaagtatgacggtgacggcatgtacacgggactcttttcttttgtgcaagtgcagtttgtcttgtcgcaaaattcagcgcactattttgcacgaccaaagaatagccactcttataaccgtgattttgcctttggttggcgtgacgatgacggcaagaatgtcacgaatacgatgacgttactccaaattaaccagagaccgcttaaaatacttgactggaaaacaccgtatcaggttatgctgaccaatttgtccaaaaatccggattaaatttgcaatctacctttttatgaactatgaataattcaggtctaattatgttattataaatgtgttttattaataccacttaattaataacggggctttagcatgatttcaaataaaatagtgtgaaaggtagttttttatgttaaggaataattattttggagagactaaaacgcattataaattatataaatgcggtaagaactgggctgtcatggggatttcattatttccgctgggattagggatgctagttaccagccagccagtgtcagctgatgtgacagccaccagcacctcaagcagtgcagtgaggaccgatgcaatcagtgaaagtagtagcagtgcagcaaaggctgaaacgactagtgcaagtagtagcagtgcagtgaaggccgaaacgactagtgcaagtagtagcagtgcagcaaaggctgaaacggctgcgatcactactgcaggtgttgcaaatgctgattcacaaacatcagcagaagtaaccgctgactctacttctaccagccaagtggtaactaataattccaataatcaaaataatacagcacagccagccggtcaagaagcagccccggtatcagaggacacatcatctgatgatagtgagagaactacaccaacagttgcaaataatgataagccagcaattgattcagttgacacttcacaacctgcaactgcagcgccaaaagcagacactgatgtatcaacgctacaagtagatgcaactacgaagaccgattcagacataaaagaggatacaccaacagataagacaaccgatacaaagactgtgcaattaaccactgttgaaggaacgtccaagcaagtggtaacgacgccgaaggaagagagctcaactgacaaatcttcgtctgtggtttctaaacagacagacaaaacgtctttgccaaccgtagcaacagcaacagcgacgacagtgtctaagattccttcagtgacaggtgattaccagtttgacgaaaagacgaagacttatacgttcacaggtaaagatggtcatcccgtaactgggttggtttacgcgaataatatcctgcaatactttgatgaaacgggtcatcaagtaaaaggtcaatacgttacaattgcaggtcatgtatattatttcgacccagccagcggcgctgcacaaacaggtgttaatcaaatcgatggtaagatggttgggtttaaatctgatgggtcacaaattacgtcaggtttttctaatgataacgccggaaattcttactactttgatgagtctggaaccatggtgacagggcggcaaactattgctggtaagacgtattactttgacaaagacgggcatctccgtaaggggtattccactattattgataatcaattgtactatttcgatttgaaaacaggagagtctgtttcaacaacgacgtccaatttcaaatctggcttgacatcacaaacggatgacacaacaccacataatagtgcggttaatatgtctaaggatagttttaccaccgttgatggattcttgacagctgagtcatggtatgtacctaaagatattcaaacatctgcgacggactggcgtgcatcaacgcctgaagatttccgtccgatcatgatgacttggtggccaacgaagcaaattcaagcagcgtatttgaaccatatggtctccgaaggattgttgtcatcagataagaagttctccgcaacggatgatcaaacgttgttgaaccaagcagcacacgcggttcaattgcaaattgaattgaagattcaacagacaaagtctgttgaatggttgcgaacaacgatgcacaatttcattaagtcacaaccaggatacaatgttactagtgaaacgccaagtaacgaccaccttcaaggtggcgcattaagctacattaacagtgttttgacgcctgatgcgaactcaaatttccgtttgatgaaccgtaatccaacacaacaagatggtacgcgtcattacaacactgatacatctgagggtggatatgagttgctgttagccaatgacgtggataattctaacccagttgttcaagcagaacaattgaactggttgtacttcttgacgcatttcggtgaaattgttaagaacgatccgtcagctaactttgatagtgttagagtggatgcggtagacaacgtggatgccgacctgctaaacattacagccgcttattttagagatgtgtatggcgtcgataaaaacgatttgacagctaatcaacatttgtctattttggaagattggggccacaatgacccattatatgtcaaggaccacggtagtgatcagttgacgatggatgattacatgcatacccaattgatttggtcattaacaaaaaatccagataatcgtagtgcgatgcgacgatttatggagtattatttggtcgaccgtgctaaggacaatacgtctgatcaggcaattcctaattacagctttgtccgtgcacacgatagtgaagttcaaacggttatcggtgatattgttgcgaagttgtatccggatgttaaaaattcattggcgccatctatggaacaattggcggcagcctttaaggtatatgatgcggatatgaattctgttaataagaagtatacgcaatacaacatgccagcagcgtatgccatgttactaacgaataaagacacaattccacgtgtttactatggtgatatgtatacggatgatggtcaatatatggcaactaagtcaccatattacgatgccatctcagcgttgttgaaagcccgtattaagtatgtggctggtggacaaaccatggctgtagataaacacgatatcttaacatcagttcgctttggtgatgggatcatgaatgcatctgataagggtagcacgacggcccgtacccaaggaattggcgtgattgtcagcaataatgatgcgttagcgttgaagggagacactgtgacccttcatatgggtatcgctcacgccaaccaggcataccgtgctttgttgttaacgacgacagatggactaatgaaatacacgtccgataatggcgcgccaattcgctatacggatgcaaatggtgacttgattttcactagcgcagacattaagggataccaaaacgttgaggtatccggattcttgtcagtgtgggtaccagtcggtgcatccgacacacaggatgcgcgcgcaacagggtctagcgctgcaaacaaaactggtgacaccttacattcaaatgcagcattggactcaaatgtgatttatgaaggtttttctaatttccaagagatgccaacaacccacgatgagtttacaaacgtaaagatcgctcaaaatgctgatttgtttaagtcatggggtgtgacaagtttccaacttgcaccacaatatcgttcaagtgatgacacatcatttttggattctattattaagaatggatatgcgtttacagaccgctatgacttgggctttaatacgccaacaaagtacggagacgttgacgacctagcagatgcaattagagcaatgcacagtgttggtattcaggtcatggctgactttgtccctgaccaaatttataatttgccaggtcaagaagtagttgctgttaatcgtactaataactttggtacaccaaaccaggattcagatctacaaaaccagttgtatgttacaaattcaaagggtggcggtgaataccaagctaagtatggtggtgagttcttggatcttttgcgtctggaacaccctgatttgtttacaacaaatcagatttcgactggtgtaccaatcgatgggtccacgaagattaaagaatggtctgcaaagtacttcaatggttctgacatccaaggtaagggcgctgattacgtattgaaggatggtgcatctcaagaatatttcaagattacgtctaatgcgaacgatgagtccttcttgccaaaacaatttatgaatcaagatgccatgactgggttcaccacagatgaaaagggcacaacttattattcaacaagtggttaccaagctaaacagtcgtttatccaaggtgatgatggacaatattattactttgatgcagacggatacatggtgacgggctcacaaaccattaatggtaagcaatattacttcttgccaaatggcgttgagttaagagaagcatttttacaaaatgcatctggtaacacggtttattatggcaagactggctcagcagttaagtctaaatatgtagtcgatcaaagcggtgtggcttattactttgatgtaaacggtaatatggtcgcagatcgtatgatgattcttgatggacacacgcaatatttctttgcgggtggttcacaagctaaggaccaatttttgattgggtcagatggtaacttacgttactttgaccaaggtagtggtaatatggttacaaatcgttttgcagtaaaccgaaacggggattggttctacttcaatggcgatggtatcgcgttgaagggttggcaaacaattgctggtaagacttatttctttgatgctgatggacgtcaagtcaaggctgccgctgaacaagccgctgctgaacaagccgctgctgaacaagccgctgctgacaaggctgccgctgaacaagccgctgctgacaaggccgctgctgacaaggctgccgctgacaaggctgccgctgaacaagctgccgctgacaaggctgctgctgacaaggctgccgctgaacaagctgccgctgaacaagctgccgctgacaaggctgccgctgaacaagccgctgctgacaaggccgctgctgacaaggctgccgctgaacaagctgccgctgaacaagctgccgctgaacaagctgccgctgacaaggctgccgctgaacaagccgctgctgacaaggctgccgctgaacaagccgctgctgacaaggctgccgctgaacaagccgctactgacaaggccgctgctgacaaggctgccgctgaacaagctgccgctgaacaagctgccgctgaacaagctgccgctgacaaggctgccgctgaacaagccgctgctgacaaggctgccgctaaggataagcaaactcaagctgtagcttacgctgctaccaaggctaagaacaatattgatcaagctactacagctgatggcatcaatgatgcccaagcaactggtatcactgatattgataaccagcatgttcctggtacttctgttgataatcaaaagcaagctgagaaggtaactgaagatatcaagaatgatccagataataagactttgcctgaagctatcgaattaccaaatacgggcgttgataagacagaaagtattactattaccggtgtagttatgctaatcctcactactatttttggtctgttgtttacaagtaaaaagcataaaaaagattagtgtagatagctataccaaagggagttaacataacatcgattattcagatatgaacttatttagggactataattcacaaataacccctcgaaaaccttgttaaaataacccccaacatctatattatagatgttgggggttatttatatgtttatataatttatagtcccttggtaagaaccctatttatattatttctgcttcaataatttttatatctttttcataatctctttctgaataattctgttcaaatccccttaataactctgaatttagtttcttagctgacatttccattccaatcatagttatacttcccgaagtaaccccaccaacgactggaacaattttcgcaattccagaggctagtccctttttggttagtgttttgtcagcaactatcctagttattttttttaataatgggtaccacaaagttttcattaagggtttccctaatatttgtttagaagcatactttatagcattagaacttgacacccgcaacagagaagctgatccatttactccagccattgttcctaaaaataataacaatccatttgtttgaatttttccatcttcttcgatcaaatcatcaaaatcatatatataggctaattgttgagccaatctgatggagtaaaccatgttttgaataatatcgccgggtattgtccctgctattgcaattcccccgggaattccagtaagaaaagaaataatagtagtattttttaccgttgctgtaatttgtttttgtgcaactttttttctttcttttaaggaaatatctaagtgcccattgataatatctgattctgttactttaaatacttttgctaaatattcagatctgttaacatgtgcaattggattttcaacgactaattttaagagtgagcgaaaatcatgattggtgattgcttctaacattttattattatttaatgattgcttacctgaatccattatttctagctccttagcattggtagtttttaattatattaccggcataaattgaatggttaatcgctgattagttgcctgagcaatctcagataataccctagtcgaagcattcatcgatccattttcaatcctagcaatggttgattgtggtttgccaattagactagcaaatgcacgttgactcatacccatattttcacggagatcacggactttaactgctacctctaaattgatgttttcttgttcaacgagttttgcaaaatcaggattgtttttacttctttcagtaacatatgcgtcaattttactcattgttggtcctccttgttaaaatacttgctgcgtcgattccgagcaattttcttttcactttctggtgttttttgcgttttctttgtgaatgcattggtgattaagtactgagatccttgtacttggaaatagatagctctctgaatatttgaagctctcttagaacgaatctcatagagattgttttctagctttttgacccataattgacgttctgcgatgattagaccgttattttcaatattttgaatggtcgcaattaatttggcagcgtctttatcaggtaattgatccaaaaattgtttaaattcattccagtcataatagtcaaattccatttttttcatattcacatgatagcttattggctatcaaaaagcaaacaaatatgttattacacaaatccttggtacaagcggaagtgtgaaattcatatttccgcttgtaccaagggattacgtctccaccaacgaggtgatttttatatgcatcaaattgtcctaccaatcaaagattcgaatgtacttaatgatgttcaagatactttactcaataactttaaagctggccggcgtaactatacagtttttcaagttggcaaggcgacactattgcgagtcagtgatgtcatgcgcttgaaacagaccgatatttttaatccggacggttctattaaacaaaatgcgttcattcacgatcgaaaaacaggtaaacctaataccttgtacctcaaaccagttcaaacagagctcttattgtatcgccaatggctacttaatcatcagctagattctgaatggctctttccgtccattcaacacccagaacggcatattacggaaaaacagttctataaaatcatgagcaaagtcggcgatcttttaagcattaattaccttggtacccacactatgcgcaaaactggggcttatcgcgtttatacgcaatccaattacaatattggcttagtcatgcacttattaaatcattcaagtgaagccatgactttagcttatttaggcttagaccaagccagtaccgaaagtatgttagatcaaattgattttggttagttttatttggatttttagttgttgccgaaggcgacttctgatacaggaaatttagcacaaacaccagcaattttaattgtggtgtgtaagtgcgcattgacctcgtttcactcggtctgctgataaccataaaatcaatttctgctattgttgaattgactatatttttaattcaatttatgtttgcacctaactaagattgttatgttttaaatatttaaaaagtgttgcagattacgctgttttaagccaaaattttttaattgctttgtgcagagaatttttataagtttggtaacaaattttgaataacggtgttgtaagatctataaatttaaactgaaatcattattttgatgttaggagtcattaagattgacgaaaagaaagtattaaaaccaattaatgaaatgcttgctgatccttggcaaattgatattcaagaattgtttgaagcttctgtcaatgaacctgacgagattaaaaagaatttgtatgattccttatacacttatattttgcaaaaaagacaataagatattattaatcgtcctggcttcgttatttagcctctaagagcctgttgagggctttttattttgctttggtataaatatatataaacagtctcaaaaccgctaaaaacgaaaaataaggcccttaaaaacgaatatagcagttagatccttgtcaagattcaaaaaaaactgactgtttgttgtcaatagtggcggacaatcaatgcgtgggagcatagtgacttgaatttaatgtgaaccgatttttgagtcgctcctttgtgttttttatttgaggtttggctctggtacagtagtacctcttttaaacctcttttataaacctcttttaaacctcttttagacccctcttgaggcttactctcccaaggcttatagaagtttatcgactacattttgtctgtttatcgactacattttgtctgtttatcgactacattttgtctgtttatcgactacattttgtctgtttatcgactacacttatttacttctgtattcaaataaagtagtattattcaaggaggttattttttgtgatgtttaatgacacggcctcaacgttcaaacaaatcgatattgattcttatcaggaaattgatcatttaaatcaatttttagctgaaaagaaggcgcattacacaactttactagcgaattcaacaggcactctactaagcgaaatgttcttctttttgctcgactacaatacccaaatcaaacccttaaaaattaatatccaatacactaaaaatttctatgcagcgacgatgattaccaaaaatctacaaaatgtgttcgggtcttcaattgtgttcactgattagatcgaagacgcagacctcatcatctctgatcactacgaacatgacgagtctttaaacggacaattcttcttattcagaaataatttcgaaccagacgattggtccttattacttaagaacgtattagcgtatatttatacgaattcttttcataaacgactgaattaaaaaccaccgtactgctaaacagtacggtggtttttgcgttattgattttcaagttgttcttgcaaccattccagattaacttcatgatgtcgtttggaattagtcatcatcttgataaacatcggttgcaagtcagccggattggcaagtgccgcgtcaatcgcacggattttagcctgtgtctgttcgatttggctttttaacagcttatccatctgttccggtgccacttgatccgtgaataatagtggtgtgtagaatggaaacgtaatcggcttattctggcgaccataatgggcaaattgttgctcaaaagccgttaagccggccgccgttaattgatagcgattcttttcccgcttagcgggcgcgtcgtccgcgactttttcgatcaatgccttttctgccagctgctgcaagttatagtagaacgaacccttcgtgaagttcacgaaaaaagcgtagtaatggctttccatgtcagccaataattcgtaatcatacgcgcccggctttttctttagtaatcccaatattaaaaattgaatcatttgctagtctccttgcccgtcagctgtgcaataaagtcggcataactcatttgaccgaacgcaaaatcgcgactcaaccggtacatcttttccttctgtgattctgggcgttgatagagttggtctagttgaaccgcttcatctgcaagttcgtcaggaacatcttgatgctgttcgaaagcttggaaataacgaatcccaaaacgccgttgcgaggccgcgtcaatgtgaatcccatctgggttagccgttaattcggcagcgttgaccaaataactatgcggatcttgcgcgacaaattgcgccatttctcgattaatctcgttaaattccgtggcgctcgcgccgaaccctgctttgcctaaaaaggctggcaattgccccgcaatgattggtaaatcaggttgccccaatgctgcacgtaaatgattgaagaccgccgtcaacttggccgcatacgtttgatagccaccatttaaactgtcactttcaccttgatgccataatacaccgattaactcactagattcctgtgcaaatttcgcctcagtaatcgcgtgacgcatcaaaagttcgtcgctcgcccactcatcgatggtgctcccaccttccgcgcaggggattaatcccaattcttcatcagcatgagcttgcacccacgccgcagcaaatgacgcagccggcccaacacccgcaacctcccgatcaaaatgaatcggttcggccatcatttgccagcgcccattgcgcaacatcttcacgcgctcgtgccgcaatcccggcacatcttgaataaatccccgcccagccatattcgactgaccgactaataaaattgacttcatcataaaaatcctcctgaaactgatttttgcattaatagtctaattagactattaatgcaaaaagaaaccacaacttaattctaaattgtggtttcttcttaatccttcgtcaaattcaaatacaaactatattgcactggtttttcaagaattaaattcattgttacgactggatcaatcttaccatctttaacaaccattgattcttgacgtaatgatttctgatcaatatcaacaagccctaaatagtagaaatcaatcccttcatcatcacttttcttcacaaatagtggcattttcaattcaccagacgcattcccttgaaccattgtttggacctctggtgactctattttccggggatgacgcgtgaacatacgcatcgtctggctattcaaaaactcatcttcgtatttgatgccgtcatcaatatcttgcgatttcgcgtaagtaataaacagcggacaagttccataagccgttttgtagccataaattgttgacgtctggtctttttcccaacctaataaacgacaagcatccttacgggtatacttcttaccaatcgttaatggcactgcttgatcgtaaccatctgccttgaatagacctgtcgccaaaacatcatccacaagtaatttgaaaaacgaatttgtttgataagctgttttaatctgcccgtttagtcgatattgattattatccaatgttacataggcatcccgcccatacttatcttgatcagccgctttaaaaaaactcaaactcaggattaatagcatcgaatccaatgtcttctgatccactctagcatttacttgctcgagggcctttttgaagtcaccaactgataccacaccatctttttcaaacaacaacttcaataataatagctcgtgaattcgcatcccattcaatagttctttagataacattcttaaaaccatatcttcgtcaatagaggggtggacgtcctctttcatcttcaacaagaactgataatagttgtcatatttagcaatcaaaactgagccatcaatcgaaccgtgcgttgtaaaatcaaacaacagcggcattctaccaagacgtttcttcaaatcttgatagtcatcgcgtaactgcttcaattcagttaaattgctattattaatcgaatcgtaaacccgttgtttggcaacttctgtaaaattaatcgtcgacatcccaataatttgatccgtactcaacttactgcggagactatttttatttcgtgaatggtcccccgttaaagcaattggaatcaaataattattcttgtagttcccgataaaatcaatcactgtcacaaaatctttacgcggaaacttccgtaaacctcgacccagttgctggataaagataatgctggattgcgtattccgcaacatcacgacttgattgatacaaggaatatcgatcccttcgttaaaaatatcaaccgtcacaatgtattgataatcaccagcttcaaaatcccgaatgacttgttctcgataatcaacattgtcttcaccagtcaaagcaattgaaggatagcctttggccgtcataatccgcgccacttctttggcttcatctttacgactacagaaaattaacccatgaacctgatcacctgaataaccatagtagtttaactgttgttcgacataatccattcgttcagaggaaaccaagttctgtaatggcgtcttctcctcaccaatttcaccgtttaattcgtagtctgtcacaccaatataatgaaatggtgctaacatgttttcttccaaagcgtcttgtagccgaatttcataggccagattgtaatcgaataactcataaatattaaaatcatcagtccgttctggggtcgctgtcattcctaataaaaattgtggcttaaaataatcaatcacccgatgataactgctagcacctgacttgtgcgcttcatcaatcatgatatagtcgaattcttcagggtcaaactgcgacaatgtattttccttagctaacgtctgaatcgtcgcaaataaataccgcgcatcccgctggttttcattaccagacaagatcccgtattccgaccaatcgccacctagtacttgatggaaactggctttggccttcttcaaaatttgttcacgatgcacaataaataagaacttcttcggattcacacgttggacatcaaacgcacccaaataagtcttcccagtcccagttgccgaaacaattaatgctttttgatgaccttcatgtcgtaggaaattcaacgacttcaatgcatccttttgcatatgattaggcgtaatcacagtgtaatccgcggactcttcagctatagcttcaatcggttcatttttctgacgattaaaaacaatcgtttgataatcagcttcataaccagcgatccaggctggcgttaatgcttctgcacgttgccattgctgttcgacctcattgataacctggtcagttaacgccgcattttcatacgaagtgatccttaagttccactcataattacgaatcaacgccgtttcagttaagttcgagctcccaataatcatcgattggtattcacccttgtcaaagatgtaccctttagcgtggaatgaatccgattgttttaaaatccgcacttcaagattcgggattttcaacagttctttaaacaccttgggattattaaagcctaaataattagacgtcaaaatccggcccgtaaccccttttaaggcaaggtccgctaatttcggtttcaacatcgttaagactgcttcagtaatgaaagccacggcaaaagtgaagcgctgacaagtcatcagttcttcatccaaatacgtcttaacatggtcttctgacgtattaaataataacttcggcaggtattcgtcctgagaaatgtagcgctctttatcaaccaatcccgctaaagctgaattttgtaattcagtctgtaaatccgtcatgaatgctccctacttgaacgttaattgtgttaaatcttgtttttgaatagcttgcatagcagctacatctgccggtgcccaggttaattgatccaattcagattgatgacaccatttcatctggctgtgcgccactaaaccaaaactttcctttgtgaactgcgcataataaaccgttaaatgaacgttgccaaaatcgtattggtgcacatcagttgcaactgctggcccaaccaaaatatcagcacccaactcttcttttaattcccgaactaatgcagcttccggcgcctcatctggttcgatcttcccacccggaaattcccataaatctccaagaatccgatcagtggcccgtttggtacatagaatttggttatctttgatgattgcagcaccaacgacatagatatctttcatgtagaacacctcgtataagcgatttagactctatatgttaatataccattttatattattttagatcagtttgtagttaaattatttatgctatacttatgttagataacataataagcggagaagaatcaactcatgaacaataacaaacaaagtagcttttttgatggtattggtttaggcattaatttaataatagcaggaatatttcttccgctactatttcataataaatttcttttaataattgcagctatactaattgcttttggcattatgggtctgggaatagaactagagaaagtatatcctaatctgggctatactaatatattcatggggtttggttttatcctattaggggtttcaacactagtattttcagtaaacatcttaacaaaagttctattcttattatttatcctaattggatttttcgcattagtctcaggtactttaaaatatttttctaataatacaaaggaatcaaaagagagaaaaactagtaaaaagaatcgctctagtttatcaattatcagtatttttagcataactggttttcttgctaatattgttacgataatttcttacttccacagataatcaatataaacgatcatattagttaatgagaactactcatattaatttagtacagcttgacttatacagattctaaaattgtggttttaaattaatcagataaaaagagggcctaccaaaaacaatacttggtaagtcctcttttttaaattttctattattccttcgtatacttcatcccgcctacaagcatgtctgttagcgcattacccgtagattcgattttgaaggtttttttgtctttagcaagttcggctgtgatttcggtgtcattgagtttaattttcaagtcgccgtctttgatttcgtaagtacctttgccggttttttgattgctttgatactctgtaactgtgtcatctttgaagacaaaagtatcttttgaaacgcctaagttagcggtgtagcgacctactaattatttttgtacagttaaactagcggattttcatccaccgccggtaaatatctgcccgccaatccggcaattaccgttagcaagccaacgctaatcaagccagccaagtgaatcaactgactggttgtgtcagacattgcgacactgccactgatttgagcaatcacggtcgtcatgtcttgttgccgcattacggctagggccatcaagccggtaatcaagataaattgcattaggatactaccgagatacgtattccgatatttaacaattaaggtttgggccggcgtcgtgacgccggtgtaataagcgcggtgatttaaaagaatgctgttggcactgccaaagaaactaatcaataagattcctaataaaatcagatgtggcgtaatcatcaaccacgcaccaacaacaaatcctagtaattggacttttaagtctgataacttcgaaaagcgcccttgtacgctctttcgaatgacttgggctaaaatcatccctgcaccgtaagtcacgtaggcgcctatcatcaaactctgattttgaattgcgacaaaaatatagagcattaagaatgtttcaaacgccccgttaattaaagccgcaaccaaaagccaacccggcatcttcgttttagtgccgcgcgtgatgatcacccgcaagattagcgcgactaacccaatgacagcgactgtgattaataaccagacaaatttagcttcaaaaaggcgcagatatcttagcgcaaacgccatcgcggttgcccagacaaatagttccaagttattaagcgatttggtttgttcgacgaacaccgattcatcaagttgcttcacaaacggttcgaagcgttgcatgccgataaagccaatcaatacaaatagcatgataacaataaagacgaaccgatatgaaaaatgactagcgatggtcaacagaccaaccgttattaggctaaaagccaataacgttttaatttcagtgcccataaggtgccatttccaaaccacccgctcgtgataataaacgccctcataggttggcatgatcacactggcactggcgcccaggataaaggccgccatgtccgttaaatacagccaaggcgaaatagccaatagcaataaggcgcctgcagctagcagcatactgatactagttattttaaatgaattctgcacgtggcctagactattcacgaataataagccagttttcaacgcggtatagaataagatatacggcatataagacgccaccgactgcccgctatgaatcatggttaagccaattaaagggagaatttgaattaacttcgccaccgcaaagacaatcccttgtttaatttttcactagtcgctaattgttgcccatttgtcatcaatcatccctactttcattgattagatggtaccttatattgcgtctgatttcaaagaagtaccgttaaaagcctaaattgattgcacaaaaaaacaccgtaagtcgttgaaacgacttgcggtgttttgattaggattttattcccattccactgttgaaggtggcttgctcgtaatatcgtacacgatgcggttgacgtgatcgacttcgttaacgattcgcacagaaaccttttgcaagataccccatggaatccgtgagaagtcggctgtcatgccgtcgattgagttaacggcacgaatcccaactgtgtaatcgtatgtccggccatcacccatgacacccacactacggatgcctggtaagactgtgaagtattgccatacggttttatctaaaccagcgagtgcaaattcttcacgcagaattaaatcactatcgcggacaatcttcaatttatcttcagtcacttcgccaaggacccgaatcccaaggccaggacctgggaatggttggcgccatacgagttcatatggcatgcctagtttttcaccaaggtcacggacttcatctttaaataatgtatttaaaggttcaattaagctaaattgcatgtcttctggtaaaccaccaacgttatgatgtgatttgatggttgtcgcagtacttgtaccactttcgataatgtcagtgtataaagtcccttgcgctaagaagtcaatcccgtttaacttagttgcttcttcgtcaaacacttggataaattcgttaccaataatcttccgtttcttttctgggtcagaaacgccagcgagtttactcatgaaacggtctttagcgtccacttggatgatgttcaacccaaatttaccgccaagactttccatcacttgttcaacttcgccttttctgagtaagccgtggtcaacaaagatgctgaccaattggtcgccgattgcgcggtgtaataacacaccaacaacagatgaatcaacgccacctgaaagaccaagaaggactttcttgtcaccgacttgttcacgaatcttagcgatttgcatgtcgataaagtcgttcattgtccagttatcttgggcaccacagacaccaaatgcaaagttcttcaaaatatcgttcccgaattcagtattccgcacttcggtatggaattgaatcccataaatccgacgttcacggttttcgatggcggtgaaaggtgtattatcactttcagcaaccgttacgaaaccttctggaatcgctgtgactttgtcgccatgactcatccacaccgtttgtttttcaggaaggcctttgaataagtcactgtctttgtcagtgactgtaatttcagccttaccatattcacgttctgttgatgcttcaacattcccgccatttttaaaactgatcaactgcatcccgtaacaaatcccgagaattggaatccctagttcaaaaatttcagggtcaactgaaaaggcaccatcatcgtaaacactcattgggccaccagagaaaataattcccttaggggcgatcttcttgatttctgctgctgttgtcgtgttaggcaacaattcagagaaaatcccgaattcacggatacgacgtgtaatcaattgattatactgactaccgtaatctaatacgataatcttatcgaaatcttgcatgtccttttgggccaaacaactcactcctctttttaaaaagcaatttggtgtgaacaagtaacaccaaattgctagattcataacactaagtcaaactataatgtatctattttactgattaataatgaaaacgtcaatggattgacggccttcctgtgaaaaaactcattctattattaatatttacgcaggaataccttatcaatcacgtgatgtttcgttttatgcaaaatgacatcggcacgattacgcgttggtaagatatattcgtttaaattttgtaaattaatgtcacgccatacccgctgcgccatcttgaatgcactctgtcggtcactgatggcgtatggataatagtagttggtcggatcatctttggctaaatcgagtaatagatcgaaacgttcaaggaaccacttcttgattaagtcggcttgcgcatcgacataaattgaaaagtcgaagaagtcactgacgtaaatctgctcagttgatggcaactgtagtacgttaattccttcaacaattaaaatatctggatcatcaatcacgtcgaactcgtcgcgcacaatgtcgtaaatctgatgtgaatatttcggtgctttgactggtccaacattatttttgaccgcattcataaattgaattagatgcggcatatcataactttcgggaaagccttttttatcaagaatccctttttgtttcagcgtggctgtcggatataagaacccatcagtcgtaatcatttgaaccttcttatccgggtaggcccggctgagaaggagttgcaacaagcgcgccgtcgtactcttgccgaccgcgacgctcccagcgatgccaatgacaaatggtgtcctatgtggcttaatctctagaaattcagatttttcggcctggcgcacctggtactgttcatagtgcatctgtatcagatgccgtaatggcaaataaatatcactcacatccgcaagtgaaatccgatcattcaatccccgaatctgttccagctccgtgtccgtgatgccagtatacgcgtcaccgcggccatgaaaaacccgccactcatcacgcgagatttcataatatttcatctcgttcttcatccgacaatcctccaatactaaacgcatccattttaacattaaaaacagagtgcgtcatcttgcgattatatttcgaggattagtctagtaccgtgaataagcgccttaaggcgattgtttgcggtgcgtaactaaccacaggaatatgcaagatgaaagcacgtttcaaaacagagtgcgtcaccaatcggttagcttttgagcatttgcctagtattgtgaataatcagcttgtctgattgtttgcaatgcgtagcaaagcacaaaaagcgattggtgtaagcacgttttcgctagagtgcgtcatcttgcgattatatttcgaggattagtctagtaccgtgaataagcgctatttagtagctcgccttttttctttataaactttttagtggttaggattgattgcaccgttacgcaagtatgctttgaactggcggtatattggtgcgaagacttcgatatcattttcgttgagcatttctttagggaaatagaagcgttcatcgccgctaaaacggcctgagatggcggccaccaagtcacttaatgatgataactcttcaagttgaccatcagattgcataatttcaatctgagttttgggtgatttagcggagggatcataggcgtcatacggcaaatcgaaactgttattaacagcagtgtaatactcactgttataaccagcttgctcggttagcgcccgtaattctggtaaaacacgttgggtctgttggctaaaggcaaccgatttgagtgggcggcgacttaaaaagcggtcggccaaatcattgagcactgaatccggatagtctaaccagtatagaaaataggtattcaaaacgccatcgtctaattttaaatagtcttgtaaggtgaagttctgttcgaaaaatggaatcaataattgcggtgcgagactctgatgatggtcaggctgttgataaagaactttcgcacgttgcaagagcttttgcaagacaacttccatgccgcgtgaaacaggatggaaataaacttgttgatacatctggaaccgactgacgatgtaatcttcaacggcatgcatcccgtttgctaaaaagacaatgcccttatcgtaaggccgcatgactcgtaaaacacgcgtcaaatcgaattctccgtatttagtcccagtattgtaagcatcccgtaataagtaatccatgcgatcagcatcaatctggctggaaatcatctggacaacttgtggattcggataagaatgatcgattacactagcgactttcgcagggaaatcatccgcaacttgggttaagacgcgattaatggctgtctccgggttggtgataatttggcgcgtaatcaattcatgatcagtattgaagatgtgttcgaaggtatgtgaataagcgccatggccgatgtcgtgcaataaagccgcacataaggcgactaaccgttcatcatcgttccaaagtccatcaccggcaacttgactagggtagttaagttggaattgatcacagatttggcgtgtgatttcataaacacctaatgagtgggtgaagcgggaatgttcagcgccttggaaaacagaggaagtcgtgccaagctgtttaatccgccgaagacgttgaaattcgggggtgtcaattaaatcgagaatcacttgatactcgacgcgaatgtagttatgcacaggatcacggaatactttttcacgcgatagtttaatagcggtgttagtcacaatataatctcctttttgaggcccgttaaacttgataacggtggagtgctgtttggtttttaagtagaagttgttgataagctttcgtttgtaattgtggtgtgaggtcaactagttgtggttgttgaaccaaccggctaaaagcggtctgtaggtgcgtaatggctgttgcaacagtcattggtacgtttaacagatcagataggttggccatggtgtccgggatgaccgctgggaaagtccaccgcgtttggctttgtgcttggccagcagtgtaaaagctatgcatgagtttgccacgtgcctgttgattgcctgtaatgctggcgtataagagtacggtaattccgtttttggcacggcgttgggcaataccggcaaacttttgaccattgatgctgagatcgtattcgccagggcaataggagtgagtgacttcgaaatggtcaatcgtgacgggatagtctgcaaaggcagttgtgaacaattggtgcatgagcgcgtaagcggcattaatgcttaggtgatccgccatatcaggaagatagaagctgacgttcaaaacgccggcatccgtcacaatccccaaaccaccagcgttacgcacgaaatgggcatagtgtgcagcctctaatgtggcaaccgcttgtggataagcaggtaactttgtatccatcatgcccaaaataacattgtcagcaagcgtccaaaaatgaataataggttgttgtaattcgcggctcaaagctaagaggctattagcatgagcaaaagcgagtggtccagccgctttttcaaaatgttgggttaaaatagcccattcttgattggcagataaagtcgctaaatcatccatggtaatcacctccgaaaattaaaaactcttcttaattatagcgtaaattctaggcgctgtctgcaatcggtacgctggtcaaagagaattggcggattattctggcgctcaaattttgaatggcttataatagaactacttaattaaaattaaaggaagttatttatggcaagtcaaagcggaattccggtcaaggtacaccttgaaacgcaaattcaacaagatgggcaacttgaaaaacacgttttcgatgaggatggtcaagttgtcaaaatgggagagtcactttacttacgttatctggaacacggtggtgaacaagccaccgcggtacggtttaaattggctgctgacggtcaaattcaattaacgcggggcacagaagaagacgagacgcaattgcggttgtactttaagcaaggtgaagacctcggatcaatttaccaaacaaaatatggcaacatgccagtgctcacaacgacaacccatttattatcgatggtgaaggaacaaccgttatcaggtgaaattacggttcattaccaacttgccatcaataatcaagccgtgggggattacaaattacgattgatttttacagcttaagctagtatgattaaggatagactgttgaaaggacgtgtactggttgaaattagacgtttttaaaggccaaaataaagaagaactatcaatgattgaagtcgcacatgcaattttagaagaaaaaggcgacacgattgcattcgctgacttaacgaatgaaattcaaaactatttaggcaaaagtgatgaagaagtgcgtgcacgcttatcacaattttatacggatttaaatgaagatggtagtttcatttctttaggcgaaaacgtttggggcctccgttcttggtacccatatgaatctgtcgatgaagaagttaaccatccagaagatgaagaagaccaaccaactaagaagaaacgtcgtaagaaggttaatgcattcttagcagatgttaccgacgatgacgatgtgattgattacagtgacgatgatccagaagacgaagacttagatgctgatgatgatgttaatttagcagctacagatgacgttgctggtgatgacttaactgaatacaaagctgacttacgaaacatcggtgacgatgacgatgatgaagacgacgatgccttagaagacggtatcgaaggtcaattatctgaatttagcgatgatgatgaagacgacgaagacgaagatgacgagctttaattagacgtttccgattcgttgccataaaaaaagacgccaaagttaactttggcgtcttttttttgcgtttaatatttttaagctaatcctcgtcggatacccgacttacgacacactctcgttcaagaaaatggtaaaccgcgccgattaagttggcgtcttggttgaagtgacaaatttcgatgtgtggcacaggaattggggtgggtgcccctgcacggcgttgccagtaacgattaatactactattgtcatcggctaaaagtgcgtcaatcgcagcgtttaattttggtagtaggtcagttcgctgactaatgccaccaccgacaccaataatctcgggcgtgtaagcaacgtttaaaaagagcatgatttccgcaagggcagcatacatctgtgcgacttctagggtggcaatcggatccccttgatcggcaagttcgaagacggttttgccgtcgattgtattggggagtttaaaattacggagggagacagtcttgccaatttggacgggtgagacttttgaattattgagtgttttaatggcatctgcgatgaatttttcgaagttatcgattttatcagcagtcgttttgagaatggtcccattttcgataatggataagccaatcccagaaccaattattgtgaataaggcgctcagatgaccttgaccaatcccagctgtcatctcggcgaatgctgcactgtcggcatcattttggagagagacgggcagaccaaggcgcgttgcaaattcagtttgaaattcaccgaggtgcaaaaatggcacataactcatgccatggatgatgccagtctgttcatctggatcaccaggacaactcaccgcaattccagttaaatgaaagtcggtcgcaaattgatcacgtaattgttcaacttcggaatagaagcgattgcgtgttagcggtgtagggaattgcgcttggttaattagttggtgtttcgtccaaatcccatatttgacggcagaaccgccgatatctaaagctagtaacgcgtcttgtagcatggtgggccatcctttcaaagtaggtcatgcaaatagtgtagcataggcgatttaaaatcggcgcagaaatgactaatttttttgcttgacgctaattgccatttcttgtattatattctttgggcgctttgcagttactttaattgcgaagccagaatcggttaacaggctccctgttcattttgaatagggagcttgtttttgtttttggttgtttcccaaaagcatgaatgtttagcgtaatgctaagaagaaaaggagaatatttatatgaccaaatatgtttttgtaacaggtggcgttgtttcttcacttggtaaaggaattgttgcggcttcacttggtcgtttgttaaagaatcgtggattaaaggtaacgattcaaaaatttgatccatacatcaacgtggatcccggtacaatgagtccttaccaacatggtgaagttttcgtaacagatgatggtactgaaactgatttagatcttggccattacgaacgttttatcgataataatttaaataaatattctaacgtgacgacaggtaaaatttattcagaagttttacgtaaagaacgtaaaggtgaataccttggcgcaactgttcaagtcattccacatatcacaaacatgattaaagaaaaaatcatgcgggctgctacaacgactgattcagatatcgtgattactgaaatcggtgggaccgttggtgatatcgaatccttaccattcttagaagcacttcgtcaaatgaaggctgatgtcggcgcagaaaactgcatctacattcatacgacattggtcccttacttgaaggctgccggtgaaatgaagaccaaaccaacacaacacagtgttaaagaattacggagcatcgggattcaaccaaacgtcttggtttgtcggactgaaaaaccaattcctgatgacatgcggaacaagattgcccaattctgtgacgttgaaccagaagccgttgttgaatcacgcgatgctgaatcaatctacgatattccattgttattgaagaaccaaggcttagatgattttgtcttgaaccacttcaagatgacagcaccagaagctgacatgacagaatggattgatatgttacacacaatcaagaacctcgaaggcacgaagaagattgccttggttggtaaatatatcgaattacaagatgcttacatttcagtgaacgaagcattacgccatgccggttatgcttataacaccgatgttaaagtgacaccaatccaatcagaagatattacgaaagaaaatgttgctgaaacattagctggctttgatgggattatcgtccctggtggtttcggtgatcgtggtttagaagggatgatcctttcaattcaatatgcgcgtgaaaatgatgtaccctatcttggtatttgtttagggatgcaaatggcaagtatcgaatttgcccgcaatgttgctggcattacagatgcaacaactggcgaagtacacccagaagcaaaacataaattaatcgacatcatgtcagatcaaaaagatttagaaaacatgggtgggacacaacgtcttggcttgtatccatgtaaattaaaaccaggtacaaagactgctgctgcttatgataaccaaagtgttatccaacaacgtcaccgtcaccgttatgaattcaataacgaatatcgtgaattgttgacagacaaagggctagtctttgccgggacttcacctgacaatcgtttagttgaagtgatcgaaattccagaaaacaaattcttcgtggcagcccaatatcacccagaattcctatcacgtccaaacaaaccagaaggcttgttcaaggcatttattggcgcaacaatgtagagtgctgactcgaacgggttggctttgaggattagccacatcaggcggattatcgacaaggtcggtagtatgactgatgtggctaaccggaatatggagcacgtctcataaaagacgctactagtcagcacgacaaagtagcgtctttttgtatgccgaaaaatagttgtgaaaatggagatgatccgttttgaaaagccttacatttttagacttctacagcccaattgaatgcgatgattagcttttactaagtatgaaaattaaaaagtaaatgttatccctaaatgccttgtaatttatgtgctgattaattattattatacatgtatgactaattatcaacggcattgagtagattggagccgtttttcaattttaaaaaataaaactaaaaaattaaaaaacttaaaaatatcaaaagcgccttctggtttaaaccacaggagaagtgggaaactgaaggcggttcttttgttgcagagcgaacggggaaatctaaaaatgaaaaaaatgttaattcaaggtggcaatctcttatctggagaggtcacaattggcggtgcaaagaatagcacggttgcgattattcccgctgctattttggcggagtcgaaagtcgttttagactgtgtgccgcacattaaagacgtcaacagcctactatccattctagaagatatgtctgtctcatctacttttgctgatgacacggttgaaattgatccaacccacattatttcgacaccacttccaagcgggaagattcaaagtttacgcgcctcatattatttcatgggggctttattaggtcgttttggggaagcaatcgttgggcttccaggtggcgacgatattggtccacgaccaattgatcaacatattaaagggtttgaagcacttggtgcgacagtgactaataaccacggtgctatccaaattaaggcaccaaacggcttacacggtgctaagatttatcttgatatggcatcagttggcgcaacgattaatttattattagccgctgtccgtgctgaaggacaaactgtcattgaaaatgcagcacgcgaacccgaaattgtggatatcgcgacattcttgaacaacatgggtgctaagatccgcggtgctgggactgacattatccgcattgatggggttgaacatctgtatgggcgcaatacacacaccattattcctgatcggattgaagcgggaacttatttaagtatggctgcagccatcggggatggtgtgaacgtcaagaacatcatcagtgaacacatggacgcttacctcgctaagttagaggaaatgggcgttaagatggatgttaaggaagatagtatcttcgtttatccatcacctaatttaaaaatggttcaaattaaaactatgccatatcctggctttgcaacggatttgcaacaaccactaacgccgctcttattaaaagcgcaaggtgaaggcattgtggttgataccctttatcctaaacgaacacgccacgtcccagaattaattcggatgggtgcagatatctcaatcgaaaatgatgtgattattttacatcatgccgacaagttacaaggtgccgaagtatccgccgatgaaattcggggcggtgcttgtttaatgatcgctggcttaatggccaatggtgtgacaacgattgataacgcaagtaatattttgcggggctatgaccgcgttgttgataaactaacgggtctgggcgcaatcgtcaaaatggttgaagaataagttaaccatctattgttttttgttagcattcatgctaatatttaatggttatgtaaacaaatatctctgacatagcaaatatctcagggcaagacttaagttgtgcatctgaattgatgcagataactttagcaaaaaggagcggaaaagacatgaaacaaggtattcatccagattatcacaaggtagtatttatggattcatcaactggcttcaagttcatctcaggttcaactgctaactcagctgaaactgttgaatgggaagacggtaacacatatccattaatccgtgttgaaatttcgtcagattcacatccattctacacaggtaaacaaaagtttactcaagcagatggtcgtgtcgatcgtttcaacaaaaaatatggttttgcagacaagaacgctgccaaataattattttgaaaccggggaatttttccctgtttttttttgcctttttttccataaaaatagccgattgcaaacggcaatcagctatttaatcaacattttttgaattcgatgactagcgagacacgctagcaaaatgactgggaaaaattgaatcgggaaaagaaagagtaacaaagtagcagtgacgtacggttgcgccacgatcaccgtacaactgacagcgacaaccgtggcaaccaggaggccgggagtgtatggcaatacaacggcgagacttaaaccgattgccgcacttgcaaagatggctgggaaaattttaccgccccgccaaccaaaggcaaatagcagattagttagaacggtttttccaagtccgattaagagtaaataaatgaatgattgatctaaaccggatttggtaaaggtgaacaagtagtgttctccagaaaagagtaaataaggcgacaatagaccacaagcacccaagaacccaagaacacaccagcgatcattgcaagtaagaccggccgctgaatcgtatcaaagagccactggcaccattgttctatttttaagaatagattgccaaaaactcaaccgacaattaatgctaaaataagaagtggccaaaccattaatgtccaatgaatgattggtgtgtgcagtgtaaatggactttctttggggaagagttggttgaccaaggcgaaaccaagaatcccagtggcggttgtgagaatgtataatagaacttgattgaagtgtgatttgaaatgatcgcgcaaggaggtcgtctcaatcgcctcaccaacaccggctagtggtgcgtggaagatggccgctagcatggcaccaatccccatcgtcaaaaacgtttctttttgctgagcggttagtttaagtcgatcgcccaaccaagtgattagaccgccgacgatggtcgagagcgcggcttcagggccaaggctagcgccgcaggctaatacaactaaggtggcgataatgtttttaccgacttgctgttggtaggcaacggacccggtttgtttaaattcgctgagtgtttcatgcattgttttaggataaggcccccaataacgttgcattaagccgacgagtaatccgccaaatagaccaacaagcaacggataaaatggctggttgaaatgcgaataaccgacttgccaaattaagtgtgtactgaaattaatgagggctaaaaaggcggccgctatgccaccaatcaacaatcctaaaagtaagctatataaaacaaaaataattttaaactgcgtggttttagtggtaggtgatgacatagagcctcctagttaagggaattatttatgaactattatgcactacccacgctagtttgaccatagtcgaattgtgagggaaagaataatgaaaatcgatcgattacaagcatttagcgatggcgtttttgccattttattaacactattagtgttagactttaaagtgccggactatcaagcagggcatttgagtcaagcggtgattgcacagtggccaactttggctgcctatgtactatcctttttttatgtggggacattatggttgtttcatcacgattattttgcgaaaataaaacaagctaactggcagttaaacgtgatcaatctcagtattttatttgcagtgacactgattaattacccaactagtttgttgtcggaatcgattgctcaacaaaatggcgctgatattcgatttgcttttacatcgtatgcgattgttgcattagtcatctcagctttgttttgggtattatatcggtatatggcactgcatcatgaactaatgcgtcagtatgaacagcgacacgaggaattttatcaaacgattaaaaatgatcccttacgaagtgtcttgatttacgccattgccattgtcggaattcagattaatagctggctaggggcactgttgattttgctgggcaatatctttcatttcatcgcatacttgcgacttagtcggagtgtcacgctgtatcatttgaatggaaaggatgaataacatggcaaaacaaaaaacaaattggcggtgggtagattggctttatgtcttcaccattgtgagtcaattaatctatattggttattaggtcaatataaaaacccccgatattggattttggtccaatatcgggggttcacttcaagctgataaaagctctgtaacacctattttcaagcaatggtggatttataccggtgttttgtcattgctactattattaatcggatttggatcagactcaaataagggcaacaaatctactaagttaacagtaaacgaaacatttgttactaacgataaaggcgttgcgacgatttctggtaagacttccccagactatggcgttaatatcgataatgccaaacaaaccgctgctgattctgacgggaaattttcttttgaatataacctaaaaggcaacagcaagaaaagccttcgactcgaagtcagcaaagactacgacgataacaccaaaaagagcaaacttatttacgtaaaaccaagtaagaaatttttggccaatagagaaagtttagcgcaagaaagctcacgcgctgctgtagcctctaaaagtcaacgaaaagcagcgtcagaatcatctgaaagccagaaaaaagccgaatcagaaaaggctaaagttgaatcagaacaagctagcgatattactcgcctgagtgaaaaaccaacagacgaacaatctgcaattctaactcagttagcaaatcaaactttttctaaaaagtacccttataagggaagcaagattcacacaattttagggaatattcaaccatggacaaaagacggcaatgtttggttcgccaaatatgaagcaaccatcgcaaacgcatttaatgctaaacgtgatgcaactcttgaaattagaatcaccccgcttagccgtgatagcggtaacgtttcatttgaagattactagaactattcagccatcggacaagccgacagcaagtgtaagccttgctggttgatttgcaatataaaaaggcacatcccccgtcgccaaacagatggatgtgcctaaccttaaaaccacactagcgtgcgcttttttgccagtttcattttagcaaacttttattttcttttaaagcgaacacccgtgcgagttgattacgtaattaaggagctgttttaaatggaagataaacgtattaagaaatacaagaaaaataacggcgatactgcttacatgtttaacatttatttaggcaagaaccctctcactggtaaagataaacgcgtcacacgccggggctttgtatctcgacgcgaggcacgcttagcaatcgctcgattagaatctgggatggaaaatggctcctatgtcaagaatccggacataaaagtacgaacaaatttgactttcaatttaaattacttaatttaattttcggaggccgaagttttagtcccgttcagattttaaaaacgctttagagtatattaaataagccccaacattattgaatttaatagcctgtagctacgctacaagtgaaatacgatcactgttataccaacgaatatagttatcaattccggcgattgcttcatgaattgtcttaaaatcttggaaattaacgtattcacgtttcaaaattgaatgaaaactttcaattcgcgcgttatcgccgggctgaccctttcgggagtaagaatgcttgataccatacttcgataaagtgttttcaaataagtcacttgtgtattggcttcccatatcactatgaataatttgtggtttaactgcttgcgccatgacttgggtaataacgttagtcgctagttctttagtcatctgcgtattaagttggctcctatgtcaagaatccggacataggagcctatcttggttgataatgacaagcgaaaagaaattgagttaccagagtttggaagtcttacagttaagtcacaacatggtaaaattatcttagttgagacagtcaataaaactaaattagagtaacccgaatagaaaaactaaagggatgaataactgccaatcggtagccgttcatctctttttatattggaagaacttagaaaaacttagtgttgggatgtgagtaaactgtttaactttgacattaacgaagctgaaagcagacaacgagcaatgaaatttttaaaacgttattggcgtataaggcatattgcgggcaatgtgagtcatttgaagagccctagctataatcacacaccaaagagccataataacgagaatgggcaggaaacacgcacaatcaaagccatagaagcacagcaagtcattgataatattgaaagtgcactggcttgtttgacagatgagcacgctaggttattgaggctaacctatatgaatgctactaaattaacgacggtaaatattagtataaatttaggtatgggagaaagcatgtataagtatcacaaagcagtggctttagttgagtttgccgaagcctatccaactggtgaactattaatatataggaagtgaatttattatgtgggtcaaccaattcgactatagagtgactacaaaagcggttaaacagctattaaaacaatatgcaacgattagaagactagcaataaacagtaatcatccctttcacaagcaagctaggcaagagttagaatgtattaaaacgacgttaaaagattttgatgatccatacctatcaattattaagatgtgttacttaagtgactatcctaaaaaagatgagtttgtggcaagtcatattggctatggtaaaacacaatactataaaatgaaaagagatgcgttactaatgtttgccgagcgttatagcaatcaagaattgttaaaagctaaatagtcgtaattgacgatatgcaacctaaaagtaaaaagggcgcacttgtgagtactgacaacacagccttaaggccaacttgctgtaggatttaaagctggtaaatgctagtcaaaacatatcaagcaaatactaacatatgctaaccttagtaatgtaattcgttaggttgttaaagttgttaagaacctgacaaaacctgacattagaaactagacaaaagtagacaatttggggactttttgagtgacgtaaaacagctgtaaacgtagtcatggtagccaatgtaatagagtatagtaaatttcgttgtaaacccttgttcagttgagtatcctgacatttctgacaccctaaagaatgttggaaaatgttggaaaatgttggaaagttaatagattggctcaattttgagcagatgacaccagtttttttggactttctccgaaattggagaaaagcgtttgtatcaaatgttttgagtagcatggaattttccgttgtatctttaggggctctaaaatctctaaatgaggttgcacaatttttcgcagactatttgaatcaaccattttgagtagggccgaattttcggccgagttaatactagatgcccccatttttggggagataaacaacgggaaggggtcaagactccgcagagatgcgttatatacgtgtgagggtggggtagtacggctgaaaattaagccctaattaattttaagtgtttttggatagaaacataatggcgtaacgaaacgttacccctaaatataatctagattaaaaaatacaaccaagccaaaattgggctcgtttgaaacatatccccaaaactggggacatccccttatctaatgaatacagtcgcgatttacgacggaaactaatgctagtagttgctagtatgatccttgacggtctatgtttaatataggccgttgtttaatgaagttagcccaaattaaaagacggccattaatatgaccgcctgcagtaagttatgtatatgccccgtgcgtgatttttgttgaatacgtgaatacggttttgaatacggtttgtcgtattcactgtgaataacaatctatttagagaaaagaaaaaggttgatatatcagtgcctaagcacgtttataccaacctatcttttaataactatgcgtcacccgggagtcgaacccggatctcaagaaccggaatcttgggtgctatccattacactagcgacgcattccgcgtactcaacagtacagtatattatattagcggagttaagcggaaatttcaagtgtaaattttgataaatcgcgataaatcaacgtttaaaaaatattcggaaagaaaacgtatttatcaaccccaaagcattgcatctgttttctgcacttgttataatggtcttgttcaaaaggataagttactagttttagtaagttgccttttattttttgccaaccatgggtcgactaatgacacagatggacattttatgtcccacggaaagtaggcgatagcaattgcgcgatgaattatctgcaatagaagcggttgcgccagatttcgtcggtatcattaagaaacgttaccaggtgttacaacatatcgattggctcgcgccagttggccgacgaacgcttgcggaacaactgaagatgagcgagcgagtaattagaactgagacggattttctgaaagcacaaggtttgcttaattcgtctaaatcaggtatggttttaaccgtgaaggggaatgaaaccctcgatcagttaagacaagtaatggatcaattcttagggttacatcagactgaacgtcagttgagtcaagtcttaggcattgaacattgcttgattgtttctggcaatagtgatgaacaaccaaaagtcctcaccgaaatgggcaaattagtcaatagtacgttacaattattattaccacaagggcaaagtattgtggcagtgatgggcggaacgacgatggctgaagcagctcatgaactttcaactgatctatcgaaacagcgcaatctaatctttgtgccagctcgagggggaattggtgaaagtgttgatattcaggccaatgcagtctgtgccgaaatggctaagcagacaggtggtaagcatcgggcattgtatgtgcctgaacaggtgagtgagaagacgtacgcgcctttgttagaagaaccaagtgttcaagaagtgttaaaactgattgaacgaagccggggtgttttacacagtattggtgaagccattgcgatggctgaacgtcgtgagatgccgattgaaaccatcaagatgcttaaagaaaagcatgcggtgggtgaagcctttggttacttcttcaatgcacaaggcgaagtcgtgtacaagattccgcgaatcggattacagattcgtgacttattgaatattccgtgtgtactggcggttgcaagtggtacttctaaagcccaagcaatccaagcgtacatgcaccttgcacctaaacagacgtggttaatcacggatgaaggtgccgcaaactcgattttacaaggggcaaccctttaaaataaaaaatttttcatttcctaaaggaggaaattctattatgactacaaaagtagggattaatggtttcggacgtattggtcgtttagctttacgtcgtatttacgcaacaaacagtgatgtattggaagttgttgctatcaatgatttaacatcaccagacatgttggcacacttattaaagtatgatacagctcatggtcaattcaaccacgaagtatcagctacagaaaacagcatcgttatcgatggcaagaacattccagtttatgctgaatcagatgcacgtaatattccttgggttaagaatgatggtgttgacttagttcttgaaagtactggtttctacacatcagaagaaaaatcacaagctcatatcgatgctggtgctaaaaaagttcttatctcagctcctgctggtgctgttaagacagttgtttacggtgttaatgatgacacaatcacagctgacgataacatcatctcagcagcttcatgtactacaaactgtttagcacctttagctaaagcagttaacgatgctttcggtatcaaagctggtacaatgacaacaatccatgcttacacagctacacaaaaattacaagatggtcctgatcgtggtggtaacgtacgtgctgcacgtgctgctgctgctaacatcatccctcattcaactggtgctgctaaagctcttggcttagttgttcctgacttgaagggtaaacttgacggccacgcacaacgtgtcccagttatcactggttcattgacagaattagttgcaactcttgacaaagaagttacagctgacgaaatcaacgctgctgttaagaaagttacagaaggcaaccaatcatttggttacaacgatgatcaaatcgtttcatcagatatcattggtacagaattcggttcagtattcgatcctactcaaacacaaatcgttggcggtggcgcaggccaagttgtcaaagttgttgcttggtatgacaacgaatcaggctttactgctcaaatgatccgtacattagaaaaatttgctagcttaatctaatttcacttttgtgaacttaggaatgcgatagcattttataaggcgggaggaggtaaactccttccgccttttttatgaaaatttaggaggtttgtccacatggcaaaacaaacagttgcagatttaaaagatattaaaggcaaaaaagtcttagtacgtgttgactttaatgtaccaatcaaaggcggcgttatcggtgacgataaccggatcgtagctgctttaccaacaatccaatacatcatcgacaatggtggcaaggcaatcttactttctcacttgggccgtatcaagagtgacgaagataagaaagaattgacattgaaaccagttgctgcacgtcttggcgaattattaaacaaagacgttgctttcgttgcttcaaacgaaggcaaagaattagaagatgcaatcaatgcgatgactgatggtcaagtattggttatggaaaacactcgtttccaagacatcgacaacgactttggcaaacgcgaaagtaaaaacgatcctaagttgggcgaatactgggcatcattaggcgacatgttcgtcaacgacgctttcggtacagctcaccgtgctcacgcatcaaacgttgggattgcaacagctatgaaagctaataacaaacctgcagttgctggttacttattagaaaaagaaatcaaattcttgggcgaagcagttgacgctccagaacgtccatttgttgctatcttaggtggcgcaaaggtttctgacaaaatcggtgttatcgaacatttattagctaaagctgacaaagtcatcgtcggtggtggtatgacttatactttctacgctgctaaaggtttatcaattggtaactcattagttgaagaagataagatcgaattggctaaagaattaatcgaaaaagctggcgacaaattagtattgcctgtagataacgttgttgcagatgcattctcaaacgatgctaagacagaaattgttgaaggtaacattcctgatggctacatggcattagatatcggacctaaagcaattgctgacttcgaaaacgtccttaaagatgctaagactgttgtttggaacggccctatgggtgtgtttgaaatggacaactttgctaaagggacattggcaatcggcgaattcttaggtaacttatcaggcgctacaacaatcgtcggtggtggcgattcaacagccgcagttaagaaattaggcgttggcgacaagttaacacatatttctactggtggtggcgcatcacttgaatatctagaaggtaagacattacctggtatcgctgctatttcagacaaataatttaaaattaagaggagattttctcatgcgtaaaccaatcattgctggtaactggaaaatgaacatgaacccaactcaaacaactgagttcgtgaatgctatcaaagccaacttacctaagtttgatcaaacagaatcagttatcggtgcacctgctgttgacttacctgctttattagaagcagctaagggcacagacttaaaagttgctgctgaaaactgttacttcgaagatgctggtgcattcactggcgaaacttcaccaaaaacattgaatgaaatgggtgttgattatgtcatcatcggtcattcagaacgtcgtgattacttccacgaaactgatgaagatatcaacaaaaaagcacacgcaatcttcaaaaacaacatgacacctatcttctgttgtggcgaatcacttgaaacacgtgaatctggcaaagctgaagaatgggtttcaaaccaagtaacagaaggtcttaaaggcctttcagctgaccaagttagctcaatggtcattgcttacgaaccaatctgggcaatcggtactggtaaaaccgcttctgctgaccaagcacaagaaatctgtgctgttgttcgtcaaacagttgctaagttatacgaccaaacagttgctgacaaagttcgtatccaatacggtggttcagttaaacctgcaaatgttaaagaaatcatgggcaaagaagacatcgacggtggtttagttggtggcgcaagtatggaacctgcttcattcttagacttagttcactttaacgactaatttttaacgcattcctgtttacgaatggcgtaaaattagctaaaataggtgtaggctttgcctgacatccaaaaaaacgctaatgctgagcattagccaaaaaaggagaaaattacatgtcaattattactgatattttaggtcgcgaagttttagactcacgtggcaatcctactgtcgaagttgaggtttacacagaagacggcggctttggtcgcgcaatcgttccttcaggtgcttcaactggtgaacatgaagctgttgaattacgtgacggcgacaaatcacgttttggtggcaaaggtgttttaaaagctgttgaaaacgttaatggtccccttgcaaaagaaatcattggtttcgacgctacagatcaacgcggtatcgatgctgctatgatccaattagatggtacagaaaacaaaggtaaattaggcgctaacgcaatcttaggtatttcattagctgctgcacgtgctgctgctgacgaattaggcttaccattgtatgaatatcttggcggccctaacgctcacgtattaccaacaccaatgatgaacgttatcaatggtggtgctcactcagataacaaagttgatttccaagaattcatgattatgcctgttggtgctaaatctgtacgcgaagctatccgtatgggttcagaaactttccaagcattgaagagtcttttatcagctgacggtaaagttacttctgttggtgatgaaggtggtttcgcacctgacttcgcaaacaacgaagaacctttacaatacttgatcaaagctattgaaaaagctggttacaaaccaggcgaagatatttcaatcgctatcgacgttgcttcatcagaattatggaacaacgaagacaagacatacaaattacgttggtcaactggtgaagaattcacaacacctgaattcgttaaataccttgaaggcttagttgctaaatacccaatcatttcaatcgaagatcctatcgatgaaaacaactgggaagactgggcatcaatcactaaagaacttggcgaaaaagttcaacttgttggtgatgacttcttcgtaacaaacactgattacctacgtaagggtatcaagatgggcgctgctaactcaattcttgttaaagttaaccaaatcggtacattaacagaatcattagaagcaatcgaaatggctaaagaagctggctacacagctgttgtttcacatcgttcaggtgaaactgaagatacaacaatcgctgacttagttgttgctacaaacgctggccaaatcaagacaggttcaatgagccgtactgatcgtttagctaagtacaaccaattaatgcgtattgaagaacaattaggtgatacagcttcatacaaaggtatcaactcattctacaatatcaaaaaataatgaatgtgtttgagccgggatattctgaggattagcataacaaggtgaatgattacgttagtaatcttttgacttgtgacgctaaccgcaggaatatggcgaaaaaaacatgttataggtgcgttcgagccgtttaggctttgaggattaacctaaaaacgggcgtcatttctggcggcttttctcatttttaaagtaggtactgttgcatcagttcaacggttttgagctgggcatcgtctgatactttatgttgcccattttcttccgtcgtcaatgtcactaatgcggtggctgaacttggttgcgcctgaatttcggtcataaaatctgccgtgaattgatatggcaccatcgtatcagcagttccatgatagaaatgcaatggacgacctgccaagtgatcaacgtgcattgataagtcatacgccgctaaccgtgctaaggtatcttcaatcgcatcttgatacttggtttgtaaggccgttggtaattgactaacctgccatttagcaagtgcaacaggcattggtgcgccaatcttatcaacgccaattttgacattcggatatcgggtgagaatcgcatcggttgtaatgccacccatcgaagtccctgtaacaccaatccgttcaggatcaactaagccttcagcactcagtgttgcaaccagttcaccaaactcggtgaccgactgcatcacaatatcccaaaattcaaacattaactcagaaaagagctgactaccatgtcgtttaccatgatacttcgcatctggtaagaccacgcgaaaaccagccttggctaaaaagtgggcgaccattaattctgactctttacggtgcgtccaaccatgatacacaaagacagttggtaataccgctttttcttgaccacttggggccacaatcaacgtactgactgccccaatttgccgttcttcagtgctaatcatctcaaatcctcctcaattgccatttatttcccgggtaatattaaccgaagaatgaacctgtaatcttaaaacggcgtttgatataaatccgcacgccgattaagagtgctgcaattacgatttgaacaagtggtggcaagactggattcaagaaacttggaatcaagattgtcacaccgtatgccgcaacaaaggctagtgttaagccgattacaaccaatgccatcttccaaaatggtggccgttgttcttttggcatttgcgtatagcgcattggataagtcatgatgatccccgcaagcgcagccgtaatgacaattgatgtaatcccaatgctggttgctgaccccttcgttgagaaataagccgcaattccattaaaggctaggtacataattaaaaagattaagccgttatcaagcatttggagttgaagtgatgtttgcttaggacgttttggcgcgtgcaacaattgatcaatcttggttgtcactggaccatatacttgtgttgcaggcttgcccttatgttgttctgctaccatttctggtaacatttctgccaagatttcagtttggcgttctgctggcacttgttcggcatttaatgcgcgtttgaacttaaataaatagtccgcatttttcttactgagttttgcttctaacccttcaatatcaactggttctggggttactactggttgttcgttcttagccaattgtcttcctcctcaattatcattaaacgttaaatctaaattcgatgatgtcgccatcttcgaccatgtattctttaccttctaaacgtaaacggccagcttctttaacagcttgcattgaaccgtattgatctaaatcagcaaaagaaactgtttctgcccggataaatccgcgttcaaagtcggaatgaatgacaccggcggtttgtggggccttcatgccttgacggaaagtccatgcccgggtttcttttccaccagcggtaaagaatgttgctaagcctagtagatgatatgaagcacgaatcaatttatccaaccctgattcagtcaccccttcggcttccaaaaattcagccttatcggcatcatctaatgaggcgatttcttcttcagttcttgctgagatggcaattacttcggcgccttctttagctgcggacgcttgaatttgtttaacataatccacactatcaggatcagccatggcatcttcagcaatatttgcaacatataaaaccggttttgatgttaataagaagaagcctttaactaacttcgcttcatcttcattaaattcgattgaacgtactgagccgccttcttcaagaacaggcttaatctttttaagcacttcgaattcggctaaggcgtctttgtctttcgtccgcgcaatcttttcaacacgcgcataacgcttcgtaacactttctaaatcagctaagctcaattcaaggttaattgtatcgatgtcgtctaacgggtcaacagttccggtaacagaggtaatattatcgtcgtcaaaagcgcgcacaacatgcacaatcgcatcgacttgacgaatattctccaagaacttgttcccaagcccttcacctttgctagcccctttaacgatcccagcaatatccgtaaattcaaaagtcgttggcacgatctttttagccgggataatttcttgaatccggtctaaacgcttgtcagggacttcaaccatgccgacgttagggtcgattgtggcaaatgggtagttcgccatttcggcgcctgctttcgttatggcgttaaataacgttgattttccgacgttgggtaatcctacaattcctgcggttaatgacatagttttttacactttcctttactttaaaaattagtttggttgggaccttgttgcatctcttgatagtggggttcatccgcaacaacgacttgtgctgcaggcaccaaattcttcttaagtttcttttcgaattcacggcgcggtaataagacggcgtggccgcaccccatgcacttaattcgaatatccatccccaagcgcaccacttcaaagcgattggtgccacaggcatgttgttttttcatctgaacaagatcgcctaatgtatacatctagctcgactcctcactttaatcgatattcacatctagcaatgcaagaatccggtttaaaccatcgactgtgctgtaatcaatctcaatctttccgcgacccttgctgttaatcgcaatattgaccttggtgtcaaatttatcgaccaattgattttcactcgcttgaatatagggtgatttaatcttggtcttcgtcactttcgcagctttaatctggttcatctggttaattaactgctctagttgtcgcaccgttaagccttcatcaatcgtgcgtttcgctaatgcactaatctgactttttttcttcaatgataataacgtccgcgcctgtcccattgaaaggtcaccattttgtaataacgtcttcacgtcattgggtaaacccaataagcgcaagtaattggcaatgtatgggcggctcttgcccaaccgttctgatacttcagcttgagtcaggtttaactttttcaagagtgtatcgtaagcttgggcttcttctaacggcgttaaatcttcacgttgcaggttttccaagaccgcaatttccatcattgcggattcatcaaactgccgcgtgatggctggtatcgctgttttaccagctaacttagacgcacggaatcggcgttcacccgcaattaattcataaccattaatacttttgcgaacaatgattggttggaaaacgcccgacttcttaattgacgctgctaattcagccaaagccgcttcatcaaatgtcttccgcggttgatagggatttggacgaatatcatcaagtgcaatctcttcaactaattcatccgcccggtttttattagggccttcgaacgctgaaaatacagcatccaaaccgcggcccaatccttttccatttctagttgccatgagctgctaacacttcctttgccaaattttggtaaacttcagcgccccgtgattttggatcataatcaatgattgatacgccatgactaggtgcttctgctaagcgcgtattccgtggcacaatcgtgtcgtaaacccgatcaccaaaatacttacgcacttcttcaatcacttgagcccctaaattcgtccgcgcatcatacatcgtcaacaacacgccttcaatcgctaagtttgggttaaaatgtttttgcaccaaacgaacggtgtttaacaattggctcaatccttctaaggcataatattcactttgaactggaatcatgattgaattacttgccgtaaaggcattgattgaaagttgccctaatgaaggtggacagtcaatcaaaacgtaatcataatcggctaagactggttctaaccctaacttcaagcgcatttcacgcgccatctgtgatgttagctcgatctctgcccctgcaagttgaatcgtagctggaacaatgtctaagttcttatgtgatgttttaataattgtttcttttagtgggaattcatcgaccaacacatcatagatatctttttcgacttgggatttttgaaccccaatcccgcttgtcgcattcccttgtgcatctgaatcaatgattaacacgtgattgccagcatccgccaaacaagcgcctagattaatcgtggtcgttgttttaccaacgccacctttttgatttgcaattgaaataacgtgtgccataatgagcctcccttattgctttggaatttcgatcgtaatccgataaacatcatcttgttcttcttcggtggctttgacggcaatcccgctttgttcaaccatttgaaccgactttttgatggtgttgacggcaatgcgtgtatcatgggcaattgctttttttgctttatcgttcgcttttttagccttcgtggtagcttcttttaaactgtcatcggttgcatcaactgtctcttcagttgattctggttcaggattcaacgtcttgttaaccagcgcttccgtatccttaaccgttaattgttcagccaagatttggtgtaaaatcatttgttgcttgaattcatccaaccgtaaaaggctccgaccgtgtcgttcagaaatttcatgattcatgatggcttcttgaacgggttgtgagagtttcaatagccgcaacttattagcaacaaaagattggctcttacccatcttttctgccaagctggcttgtgtgaagtcgttcagcttcattaagtccttataagcttgtgcttcttcaacggcggttaattcttcgcgttgtaagttttcaatcaaggccattgaagctgtttcgtgatcatccatagtttgaacaatcgctggtaattcagcccatttgagggtttgaatcgctctaaaacggcgttcacccgcaataatttcatatttttgatcttcatattcacgtaagataatcggttgcaataagccgtgttgttcgattgtgcttgctaattcggcgatattgtccgcattaaatacttttcgtggttggaaccggttaggcacaattgctgaaaccggcactttgatcacttgattaatacttttatcgtcttttttcttattaaaaaatgagagtgccattatttttcctccttagccattaacggttttttaactggcacaccagcccgccgtggatacttggcaggtgtcggtacaaccttatcaattacgattagatgtcgttgatcatctgtttctggtagcgtcaaagcaatgtcttgtgcaaattggccaccaagtgtttcgattgcatagttggcttctgccaattccgtttcaccttgactcgcttttaatgcgataaactgcccaccaactttaacagttggtaaacagaattctaccagtacatttaatgaagcaacggcccgggcagtcacaatatcaaactgttcacgatatggactcttcgggttgctgaacagttctgctcgatcatggaccaacgtcacatcagacaagcctaattcacggaccaattcttctaagaagtgaatccgcttgtttaatgaatcaacaatcgtaatcttcaattgcgggaataaaattttgattggtaacgatggaaaacccgcgcccgcaccaatatcgcagatcgtaaggggttcagtgcgtagtttttcaagatacaaagttggtgtgacagaatcgaagaagtgcttgagataaactgcttcttgttctgtaatggctgtcaaattaacttgttggttcacttgtacaagccgtttgaaatacaattcaaactgatccatttgtgcttgtgaaacttgaatattgtatgtttttaacgttgctgcaaaacccgctggtgtcattatttctccttaactatgctttaaagtaggcgtttaattcgtggaacattattgtttcacatataccttttagtttaacgtacttaccctaaaaaaacaagattcttcccagttttcagattatcgtttcatgtgaaacataataatcggtaatttaagaacaattatcgcctttttcaagcgaatcattcagtaagaaagcacttttgtcatcgaacagttggtgtgcatcatcacaaaggcgaactatcgcgattatttaagaatgttatattcgttttttacttaatttctaattgaagtcactattggcgtgtgctaaactaaatgttaactaaattttaacaattatcttggagggacactcgtggcagatatacactcaaattcagcacagccaattaatccaaatgaaaagcttccccacattaaagcagcgattctcggcttacaacatcttctagcaatgtattctggcgatgttttaattccattacttgtcggggctgcattacattttaatgccgctcaaatgacttacctcgtttcagtcgatattttcatgtgcggggttgcgaccctattacaattaaaacgaaccccactgaccgggattgcattaccggttgtcctaggttgtgctgttgagtacgttggcccgttagccgccatcggcactaacagccaactcggaattgacgttatgtacggtagtattattggcgccggaattttcatcttgttagtttctggcttgtttgcacgtttgcgttggctcttcccaccagttgtcacagggtctctcattacattaatcggattcacattgattcccgttgctttccaaaacttaggcggtggcgatgttgctgctaagtcgtttgggagtacaccaaacttaattaccggtttttcaacgattgccctaatcctgatttttagtatctgggggcgtggcttcatccaacaaatcgccattttaattgggattattgctgggaccttaatcgcagctgcgattgggattgtgtccttagatccagtaggtcaagcaagttggttcaaattacctgaattattctacttcggaacacctcgttttgaatggtcatcaatcgtttcaatgtcattggctgcgttaacgaccatgattgaatcaatcggtgtcttcttcgcccttggtgaaatcgttgggcgcgacattactagcaatgatcttaagcggggcttccgcgctgaagggattgccgctatcttagggggattgttcaacaccttcccttactcaacgttctcacaaaatgttgggattgttcaattatccggtatcaaaacgaaaaaaccagtttactactcagcattcttcttaatcatcttaggattattacctaagattggggccgttgcaaccattattccaagcgctgttttagggggcgcgatggtcgttatgttcggcactgttgggattcaaggcattaagatgttacacaaagtcgatcttgatgataaccgcaacttactagtcgctgccgtttcaatcggcttaggcttaggggtagcaattcatccaaccttgctccaatcactaccaacgagtgttcgcacaattctaggcaacggcttagtagtcggcagtctcagcgctgtcatcttaaacttactattcaactatcgttcattaattgcagcaaaacatgctgaacaaaaataaatcaaaaaaagtgcctacaaatttaaccgtttgtgggcactttttttgtctattcaatttcagttgtccgaatacttctagcaagtctatttgtcatttcaaacagctgcattaattctggcatgctaattttcttatctgattcagtaatacttttaatgtaagttccacacgcctgctcaaatcgacgataaattgattctccagcgggagaaactgctatatcaacaattcgacgatcatcctgtttgccatattgtttgctgatatacccctgatcctctaatttacgtaatttatttgaagatgctgcggtagatgtttttaatacttgtgcaatcttactattattaatacctttatagcgttttaatgtttgtaaaatacgaatttgttcgatggtaactccgtcttcatttaaaacttgactaatgtttgctgaaatttgagccatctcatgatagaaattaatcaactctaatttatcagtcgattgcgctatagaattcatcattcctcctccgtttcattcataatcctttgataaaactggtgccatcggctaaaatactgttgcaatgagaaacagtcgttaatcgtttgccgggcatttcgtgaatatgtttcacgtcgcatctgactacctagaaaatcactgagttgttgaactaagccagcgtcatctcctggtgtcaccaaatccccgttcacatgattctcaattacttgtggaatgtccccgacattcgtagctaaattgggaattccataagccatcgtttctaaaattgccattggtaagccttcttgatatgtgggcaataggtgtaacaggctttcttgaataacggtattgcgatccgccaaagctaaccagccaccaaggcgcacattggttaactttaggcggtctatttcttgctggaccttcccctgttcaccatcaccatacaacgtaaattgaatatccggaaaacgggattgaatcacccctgctaattttagaatatcgtaggtgcccttacgttcgcctaagcgccccagtgtgataatttgtttagactgactatggtatttgtattgcttaggtagttcaaccgcattagcaataatcgtaatcggtgtttgcgtaagtgtttggtaaaaagttgcccattcagtgcttaacacaacaatgccatccatagctacggaaaacaatgttaatattaattgaaattcactatagattcgcattatattaactatttttggatataaataaatttttaaatatctttagaatattctcataaaactaaagtaacgatgttatcattctatttctccctcccattattgtcatctaattaacgaatatcagttaatatgcccatcaaaaaaaccatcataattaaagtaaaaactttaattatgtcctgcgcttttttgcttaaacgatttgtcctgtgtaaggttcgccggcgacaaattggaaatcaaaggttgctaattcatccacactggttagacattgggtaatccctttagccaacattaggttgatgggattggcttgtaaatcatcttcacaaacaaagacgattggtttatgacaggcattcaagtagccgacttcaaacgccgttcccgtatcttcgtcttgcatatcccataacacaactgccatgtctgctaaatccattgctgtgatgtcgttttgatacgtttggttggcccattcgtaacccccgaacatgccttctggatcatgatcttctgtcacacccttgtattgatgctcctgtggactatgaatataaccaatcgttgggttttgttttaaagccgcgtgtgcgcgttccactaatgaggcctgtttaggtgtaaaccaaccgccagctaagtatatttgtttttgcattatgattctcccactaaaaaagcgacgagcaagtcgaccttgtcatcgctttttaaaatttttaattgaattgtttagaattcatcttcttgtgcattggagtttaattccactaccttaccggttctgaggtagacaatccattcacagatgtttgtcacgtaatcgccaatccgttcgaggtagcttgcaactaacatgtagtccatgctcccaacgacggtttctgaatcacgttgcatttctttgatacagtcgtcataaatattgtctgaataagcattgattgcaacatcttcatcggcaattttgatggccttcttacgatcttctttgacgtaagcgtccaatacctcttcaaccatttgtttaactttgtctgccatatccgcaatatctttttcgatatcagggacacgggtattacccttgacccgaatcgttgatttcgcgattgaaacggcgtggtcacccatccgttctaaatctgaactagccttcatgattgtgacaatcacgcgaaggtcagttgagaccggttgttgaagtgcgattaactcaaaactcttacgttccaaatccgtttcccattcattaatcttatgatcgtcagcaatcacctcgcgtgcgagttgcttatcgtgattaatgaaggctttaacagatttatagatggcttcgttgaccatcatccccatttcggagaagcgaacgtgtaaatcatttaactcatcttcaaaaagtcgtctcattgtggtttcccttctttcttagccaaaacggccactgatgtaatcttccgtttctttttcggttgggtttaagaaaatcttcttcgttggtgcgtattcaatcaattcaccttgtaaaaagaatgctgtcttatccgaaatacgagaagcctgatgcatattatgcgtcaccattataatggtatactgttggcgcaattctagcaacatattttcaattttagcactcgaaatagggtctagcgcagaagtcggttcatccattaagatcactttcggtttcacagctaacacccgagcgatacaaacccgctgttgttgaccaccagaaagtgataaagcactttcgtgtaacttatctttgacgtcgtcccaaacggccgcttgtttcaaactactttcaacggcttcatctaagacgcgatgatctttaacaccggataaacgtaagccgtaaacaacattgtcatagattgaaaatgggaatgggttcggttgttggaacaccatgccaacttctttccgtaacttaacggtatccatctcaggcgcataaatatcttggccattcaataagaatttaccggtcaccttcgccgagtcgattaaatcattcattcgattcaagcagcgcaagtaggttgatttcccacaaccagatggcccgatgagcgccgtaatttcattttcaacaaaatccatattaatcccttttaaggcctcattcttaccatagaatagatgcacatctgaggattcaataatcttatttgccacggggcaaacctccttgcgtcctagccaaagtgaccagaaacataatcttcggccgctttaatcttcggccgggtaaacattttacgtgtttcgtcgaattcaagtgcgtgccctgaatggaaaaaggccgtgtaatcactgattcgtgctgcttgttgcatgttatgcgtcacaatgatgattgtaaattcttcttttaagcgaatcaatgtttcttcaaccgtgttcgttgaaattggatcaagagctgaagccggttcgtccaataataaaatatcgggtttcatcgcaattgcccgggcaatacataaccgttgttgttgcccaccagatagtgccaatgcgctctttcctaatgaatctttgacttgatcccacaaagcagcttgttttagtgacgtttcaaccacttcatccagatactttttgtctttttgtccatgttgtttcaaggcaaaagtgatgttgtcatagattgatttggcaaatggattaggccgttggaacaccatgccgatatgttcccgcatcttatacacatcaacgtcatcgctattgatgttcaagccccggtacataatcttaccggtcacacgtgtattagcaatattgtcattcatccggtttaaactccgaagataggttgactttcctgaaccagaagcgccgattaacgcggtaattcgatagcgttcaaattgcaatgatgcatcgtgcatcgcgcgtttgtcgccgtaatagacgtttaaatcttcagttgataaggcaatttcatgttttggttcatctaaatgtttgatgtgcgtttttgttaaatcgtaatctgccattattttctcctatgctgctgtcattttacggtagacacgcttgccgatgacccgtgctaaccagttaaatagtaaaacggcgatgattaagacggcagatgcgccagcagaaaccgcagtcgcatccggcataatcccttccgagttaatcttccaaatgtgcaccgctaatgtttccgcaggtcgcaatggattcaacggactcgcgatgtacattgggttccagttggtaaaatcaagtgatggggcactttgtccagctgtataaatcaaggcagccgcttcaccaaagacccggccagcgcctaaaatcatcccggtaataatgttgggtaacgcttctggaatcacgacatgcttaaccgtttcataacgcgataaaccaagtgcaagacctgcttcacgttgtgtgaagtgaattgattttaaagcatcttccacattccgcgttaacaacggtaaattgaaaacggtcaaggctaaagcacccgctaagattgaaaagcctagcttaaactggataacaaagaccaagaaaccgaataacccgaccacgacggatggtaaggaacttaacacttcaatcgcggtccgaacaacattcgtcacccagttcttcggcgcatattctgcgagatagatgccggcaccaattgataacggtactgaaatcaccatcgccaaaattaatagatagaatgaattaaacagttggacgccaatcccgccacctttagtaaaggtttgcgcaggtttcgttaaaaactgccacgtcacgtgtggtaatccgcgcaccaagatatagccgagcaaacttgctaataataatacgatcaaaccagcgatgagggttagcacaccggtggcaactttatcccatttttttgcatccattagcgacccattgctcccttccgaccaattaaacgaactaataagttaaatagtagtgacatcaataataagagtaacgccaatgaccaaagtgcattattggctaatgaacccatgaccgtattcccaatgcccatcgttaacacactcgttaacgttgaggctggggtaattaagttatgtggtaataacgcagcgttcccgatgaccatttggacggccaatgcttcaccaaacgcccgggccatcccgaaaacaaccccggttaaaatccctggtgtggctgcttttaaaacgactttccatgttgtttgccaacgcgttgcacctaaagcgagtgaggcttcgcgataatgccgtggcacactcttgagtgcatcgactgtcatcgatgtcacagttggtagaatcatgacgaacaaaacacaagtcccggcaagaatcccaaagccactgccaccaaacaaatgacggacagctggtacaatcacggataatccgataaacccgtaaacaactgatggaatcccaacgagcaattccatcactggttgcaataatttttcaccccgcttaggtgagatttcagtcataaaaatcccagcgccaattgcaaacggtgttgctaataaagccgctaagaaagtcactccaaatgaccccataatcattggtaaggcgcccacttctggtcgaccatgactatctttcaaacttggattccaattagactgcgttaaaaagcggcctagattgattttatctttaaagaaggtcgctaacccttttgaagcgacgaagtagaaaatggcgagcacgatgaacacgattaaactaatacagaataaactgattaatttgccccgtgtttcacttttggctgcgcgtgatttcttaagtaaacttgctttaattggatccataattggccccctacttaacctttgtaattgtgccatcaaccgaccgttcaaccgtcatcttagcaactggaatatagcccatcttgccgacttgtttatgttgaacctcatctgataagacatacgccaagaaacgttttgttaacccagttggttgccccttggtgtaaacatgttcatatgaccagattggccatgcattagtcatcacgttttcatcggttggtgcaatgccgtttaatttaaccattgcaatcgaatcatctacgtatgaaaaagcaagataactgatggcccctggcgtgttcgctacaattgatcgcaccatccccgttgaatcttgttcttgagcgggtttagtcttgcgcgacttcatcacccattgttcaaacgtcgtccgcgtcccactaccttgggctcggtttactaaaacaaccggctgatctggtccaccaacgtcttgccagttatcaatttcgccactaaaaatcttcgcgagttgcgtcaatgttaagtttttaatccctaattgcttattaatgactggggtaatgccgacaacagccacgcgatgatcgaccagcttgtccgctttaatgccagccttttcttcagcaaataaatcagaattccccatctgtacagcgccagattgaatctgactcaagccagtcccagaaccgcccccctggacgttaatgaactgaccgctgtgatcagcactgtattgttcagctaacgcttcaatcagcggctgaagggctgatgagccgaccgccgttacggactgaccattttgtttagactggcaaccagccaatagtaataaactgaatgtgactaataagccaataacattacgtttgcgcatgttaatcctccacgaattccatttaaacctcgtaagttccattataaaaaaggtttgtaaaaactaagcctatcaaatgtaaattttgtgtaaatcaagcgtttggtagcttcaaaatgaattcactaccgacacctaattgactctctacggtcaactgcccctctaaactggcggtaatctcgctagcaattgctagtccaaggccggtcccgctcttatgggtcgcgcgcgcttgatcaacccgatagaatcgttcaaaaattctttcttgtaggtcacttggaatgcccaaaccggtatcgacaacgcggataacaatttgatctttttcaagttgcacggcaatcaccaacgagccgttttgtttattatacgtgatggcgttagcgattaggtttttcaagatttgattaaacttcattttctgaattctaatcgctaaatccgttggaatatcaacggagacgtgtaactgcttttgttgtgccttttgttgcatcagttcgagattagcctgcaccaattcacgtacattcacaagttgctcttgcgattggtccttacgatctagatgcgaaagcgctaaaatatcttgaatcagcgcagttaatcgcgtactttcgtcatagatgatttgtaagaattgcttttgcgtggcaggatcttccgccgcaccagctaacaacgtctcagcaaagcctgtaatagccgtcaccggcgtcttcaattcatgactcacattgctgacaaaatccaactgcatctgctcaacgcgccggacatcggttaaatcatataaaatgactaatgcttggaatttcgatttaaccgtattgagttggacaacattcgcatccacaaaccgttcttgattttgaatcaactgaatttcttggtgatgactctttcggtacctaaaagtgtgctcaatcatccgtgttaattcatacgtcttgatatcatcaatataggggtgtttctcagtaacaatcgtcgtctccaataaccgatccattgcttcattgtgcaaaacgacttcacgattttcgttaattaccatgacgccgaccggtaaatggtcaattaggcggtcaaaactgccctgttgcatggcaatcttctgccgcatatgccgcatatcaccatttaatttattaatttcttgcgcgaggatatataatgacgcatctttttgaaaaataatcggttcgggcacttcttcatgccgaatatgatgaatattagcgactaaaattttcaagtggtcaaagaaatgacggcgttgccgccagaaacggtatagaaaaatccagctaccgattaaatagacaatcgtgaccgataaagcaatcttcggccacgtatgccagaactgttgctgaggcactactaagacaaagttgggccgatctgcttggtgtgcgtaaaacaaatacggttgcttattaactgtttgccgcgtactaaaattggcggcagaatgattccgattgacaatatccgtcactgctttttgcaactttgttttattcggcgattttggcgtcaaaacttgtaagccgttttggcgtaaccacttttgccgatcaaactgtggttgtttgataattagcgcatagtcggcgccccgttcctttaacatcgcgtcttgttgttgggcaatcaccaaattgacaagcacaataaaacctatgtaaacagccactaaaatagtggctagctgataaaatctaaattgatcatgtttggtcatggttggggtcctccaattgataaccgaaaccacgcaccgtttttaagtaaactggatgacgcggatctgtttcgattttttcccgtaaatgactgacttgaatatcaaccattcgcgtttcggctggataatcaaagccccacaccgcatttaagagtttctcacggctttgaaccttgttaatccgatgcataaagtaaacaaggagttcgaactccttaggcgttaaatggagcttctgagtgccctttttagccacaacttcgccttcatcgaccattaagtcccctacttgtaaaatatcactagggtgcgtttcaacgactgctacaggctgtgccgtccgccgttcaattgcccgaatccgcgcgataatttcgcgtggactaaatggtttagtgacatagtcgtctgcccccacttcgaggccgacaattttatcggtttcgctatccttagccgttagaatcataatcggcgtttttaactttgcctcccgaatcttcttggtaacggtaattccgtctagcttaggcaacattaaatctaaaataataaaatcaaacgactgctgtaaagccatcgtcagcgcttgtgcaccgtcagttgccgtcatcactttaaaatgttcttgttccaggttatagcgtaataatgtcaagattgctggttcatcgtctaccactaaaattgtcttcattcatgccaccctttatttacttaattctctgggaataatacaacgcctaactcatgtggtgcatcagcaaaaattgcgccttcagccatccggaactcaccgtttaaatcttgaacctttaaatggcaatacgttggctgactttgaatcgcccgataaaaattatcgttatttgagacagcctcgccattacattcaacaattgtatcgccaacgaccaaccccattttagcagccggcgtttcgcgtaaaatccctaagataaagacgccatcgtagggtttcgtaaagtgcaactgccgttcatgggcactgcgtctactcaaccgccattgtaatgcacagcttagtactagcgcaactgttaacatgccaataatccagttcggaaatgcaacggcaattaacccaaacccaactaacaacaagccaaagatcaaatagctattggcatttttagtaacaactgatttcattaagcctttgactgctttcaaactaaatcccaataacaatggcaagattaccaagctatatgattgatgcccgatatttaagaccggccaaaaacccaaacttggcatatcaattgcccctggcactaagaaaaagaccggcgcaatataaatttgtcgactcataaagaaggccgtcaaccgccctcgcttgctagtcatcacacgcggtgtcacagttgcctcggcatcccaacgttgtaaaacactattgatgacggtcactaacccaataatcaccaataattcagccaaaagacttgcttgaccttccatctgatattggggccatatgaatgttgcaccagcgtagaccaaagcactgattaaaaaggttgccgatacgttttgccatctagcagccactagcaaactcaaaatagcgattagttgatagaccagccaccattgcatattaaccatcgcccctaacactaaggtacagcaacttaaggctagccctgcgagtagcccatggcccacaaaatggcccacttctatccatcgtggattaatcgcaattctaaaggtcttccgttccaagctaattcgtctatgcgctaaccagccagcatacacaatcgctaaccataaaagtggtgccgttagtaatggtcgcaaaatatcaatgatcatcgtcaattcaacaaacccccagcgtctatatttaaataccgtgcgtgtttccaatgacacacgctcgatttccagctgccgaatttcgcagttatcccaatcagtatagcattttgcccccttaactgcctagggttcaaaaaaagagtgattatgattggtcttttttagaataggtaataggcagcaagtacaagaggaattgcgatagcgcagacgacacaaacggcaccaataagtaacccgtttttatggcggttaatcgttgtttttctcagcaagaatcgggatccaaaaaataacagaatggtaaaaggatgaggggaacattctgagccaccccttcgacaggtggaaaggttagcattaaataatctaatagcaaataaaggagtgttgttaatataaaaagaaatagtttcaatggctaatcctccatagcgctagattaaaaaatagaaattcagatagataaattgttaaaattggttttaaaccgttttcttaattttatagtagcatcatgattggtaataatcaaaaatctttaagaataaaaaaatcgtaactgatttggttacgattttttgctgtttaatagtctaattgtttcaaatgaaggaggaagtgctgatcatcaatcggttctagatgataaagcactagaattttacgcgttaactttggttcaatcggtgcagcatcgtcaaacatatggaagtgatcgaaaaaggctgtattgacttgctcgattaacgttaaaatgccggcactccctaaatcgaacccaagatggtcggtgtctgataattgactcgccttaatatgggttaagtattggatcagttcgggtcccattgccataattttatcgggcacttgggtcgtttttaacagtgtttttaaatctgcgattgtattagcgggtacttgttcaatcgtcatcataaacatcgcctttctagcagctatgtatctgcttacattcctaatttaacagatattatcaaaatgtctagtggatctggttgaattaatcgcgctttgcgcgaaatttcgctataataagtgcaatcgtttaaaagtggaggacaaagagatgacctattcagaacaatgggatttagaaccgatttttgccggggggattgattcaccagcgttgacgcaacgattggcggatttgactgcacaaatgacgcccttattagaagcggtccagaactggacgtttgcgacagatcagccaacatttgcaacgctaacgcaaattactgaacagttacaagcgattgaagcgggtctcaagcaaacggggagtttcgtgaatatgattcaatcaacggatgaacgcaatccgcaagttgcaccgatgatggggcggattaatgcgcttgaaaatgatgcgaatcagattgatgtcgcactcacaaaaaaattggtcgcaatgtcagacgcagattttaaaaccgttgtatcgacacctgccttacaagcgattcagtttaatctaaccgaaaaacggacgaatggtgctgaacttttggatgaagcgacggaaaaactaattaaccagttcgcgttagatggtttaactggatggagtgatcattacgactcattggttgctgaaattcaagtccccgatggtgagacgactttatcggcgggacaagcgcagaataaatttgaatctgatccagatcccaaggtacgccaacgcgtctttcaaaattggtaccagacttgggatcggtattcaccattattaacggatacgttaaatcatttggctggcttccgcctaacggattatcaagcacatggcacaacggactttttgaaaaagccattggcaacgagtcgcatgcaacccgcaacgttagaagcgatgtggtcgatcgttagtcaaaataaagcgccgcttgtcgattttctaaatcggaaggcagcgttaatgggcaaagaacagcttgcttggtatgatacctgggcaccagtggttgtaggtgattttcaaccgcagcgttattcttatgatgaagcagcggattttatcatgcagaactttaaagcgttcagtcccaagatggcttcggtggcacaaaccgcgtttgaaaagcgttggattgaagctgaagatcggccaggcaaacaaccaggtggttatatgactgatttacctgaaacggatgattttcggatttttatgacatttgatggcacccccaatggtgttgcaactttggcacatgaattagggcatgggttccatacaatgatgattaatgatttaccaagttggcgacaagactatgcgatgaacgtcgcggaaacagcttccacttttgctgaactaatcgtcagcgatgcgactgttaaagcagcgcaaagcccagcagcgaagattaatttattggatcagaaaattactaacgcaattgatatgtttatgaatattcacgcacggtttttattcgagcgacatttttatacagcgcgccaaaatggcctgcaaacaacagctgatttaaaagcactcatgctagccgctcaaaaagaagcctatgcggatgcgttgactgattatgatccgctattctgggcggacaaacagcatttcttcttcgatgacgtgccgttttataacttcccttatacgtttggctatcttttttcgatggggatttatgccaaggcacagacaatgcctgattttgaagcggactatatcgcactattacgtgatacggccaatatgtcgactgaagcattagcgcaaaaacatcttggggttgatttaacccaaccggatttctggcaagctgccgcggatagcatcgctaaagatgtacaacaattcctagctttgacggcggactatctcagataatgacatgctatttttaaattggtatatcatggtataataaacgagaatcgggcgctcacactagttggagtgaccaaattgatcggaggttttgaaatgccaacatatgaaggtagcgatattcaagcagcggtaaatgaagggttgcaagccatgcatctaacgcgtgaggaagtgtccgttgatgtattggaagccggcaaaaaagggtttctcggttttggtcgccgcttagcagttgtcaggctaacgccaaatgaacaaccaagccaagttaaacaaagcgccccagccccagttcaagagctagttgaaccaacgccaacagataatttaactagtacgccgcaaaagcggaaaagtggtgcggaaacggaagctgagttaagcgcctatttggaagccatcacggctcaaattggcacaccggtcagcattcatgtaactcacgaccatcggagtacgacttatcatttgaagaccgataaagaaggcttgttgattggtaagcatggtaagacaattaatgcgctccaatatttagcgcagacttactttgatcatcatatgaagggcaagcaaaccattatcctagaagttggtgattatcggcagcgaagagcagcgattgtcagccaccttgccgataaagcagcccgtgaagtcgttgcgaccggcaaaccagtctttttagaaccaatgccggcttttgaacgcaaaattgtgcatgggcatttagcaactaatcaccatgttcaaactcattcagaaggccaaggcgatcgccggtcaattgtggtggaattagcgcgcacattttaggtgttgtgaattgacgctctaaaaaaatcgtgtataatgaaactaattaaatatcgataaagtagtgaaagtgctttgtccaccccttacgcaatgacgggaggggtggacgctaagcgctttttttatgcagctatttcggaaaggaagcatttaaaatgccaacgacagtcacagaatttgatacgattacggcgatttcaacaccacctggtgagggggcaatttcaattgtgcgtctttcaggggatgagagtttagccattattaaacgcgtttatcgcggcaaagatcttgatcaagtggcgagccataccattaattatggacacattatcgatcctaaaaccgacgcagtagtcgatgaagtcatggtgtctgtcatgcgcgcacccaaaacgtttacccgcgaagatgtgattgagattaattgtcatggcggaattgtcgcaacgaaccgcatcttacaattattaatgagctatggtgcacgaatggccgaaccgggtgaattcacgaaacgagcctttttaaatgggcggattgatttaacccaagctgaatctgtgatggatctgattcgggctaagactgatcgggcgatgcaagttgctgttgatcaattagatgggagtttaacgcacctgattaagaatttacgccaagaaatcttagaagtattggcgcaagttgaagtcaacattgactatcccgaatatgataccgatgaaatgacgacgcggattctacttgaaaaagccgaacttgtgaaagcgcggattggtgaactacttcaaacggcacaacaaggaaaagtcttacgtgaaggcctagcaacggccattgtcggacggcccaatgttggtaaatcaagtttgttgaatcacctattacatgaagataaggcgattgtgacggatgttgccgggacgacgcgtgatgttttggaagaatatgtcaacgtccgtggggtaccgctgaagcttgttgatacggcaggaattcatgataccgaagataaggtagaaaagattggggtcgaaagaagtcgcgcagcaattaccaaggctgacctgattttattagttttaaatcaaagtgaaccactaacggttgaagatcgcgagttaatcacggccaccactgataagaaacggatcattattttaaataaaaccgatttaccgaacttgttagacttaaatgaactccaaacattggtgaatgcggatgaagtaattcaaacttcaattttaacaagcgaaggggtgaccgatttggaagcccaaatcgccaaactcttcttcggtgggattgaaaatagtcaaagtacggtcatgattactaatgcccgccaaattggtctattaaaccaagcacaacaatcattagatgaagtcatcagtggaattgcagctgggatgccagttgaccttgtgcaaattgatatgaccaactgttgggataagctcggtgagattaccggggattcagcaccagatgaattgattacggaactctttagccaattctgtttaggtaaataggtcttgaaccatattaaaggagaacaaaatatgcgagaatatgacgcagcgcactacgacgtgattgttgttggtgccggccatgcaggttctgaagcggctttagctgctgcacgaatgggccgcgaaacattactattaacgattaacttagacatggtggcttttatgccatgtaacccatcattgggtggtcctgctaaagggattgtcgtccgtgaaattgacgccttgggtggtcaaatgggccgcaatattgataaaacatacattcaaatgcggatgttgaatacaggtaaagggccagctgtccgcgcgttacgcgcccaagctgacaagcacgcttatcaccggacaatgaaacggactatcgaaacgacggagcacttaacacttcgtcaagggattgctgaatcattgatcgttgaagacggtgtctgcaaagggattgtcactaacactggtgcccgttacagcgctgatagtgtgatcttaacggctgggacagcttctcggggtaagattattatcggcgaattaacctattcatctggtccgaataattcaattccttctattaaactttctgaaagtttggaagacaacggatttgtcctcacgcgttttaaaacggggaccccaccacgcgtggacggcaccacgatcgacttttcaaagacggaagaacaaccaggggatcaggaaccaaaccactttagtttcgaaacacctgatagtgcttatttgaaagaccaactttcttgttggatgacatacacgaatgatacgacgcatcaagtgattcgcgacaatctcgaccgcgccccaatgtttaccggcgtaattgaaggggtgggtccacgttattgcccttcaattgaagataaaatcgtccgcttcgcggataagcctcggcaccaaattttcttggagccagaaggccgcgaaacagaagaatattacgtcggtgatttctcaacctcaatgccagaagaaatccaacacaaaatgattcattcgattgaaggcttagaaaatgcccaaatgatgcgtcctggttatgcgattgaatatgatgtcgttgaaccatggcaactaaaaccaacccttgaaaccaaagtggttgaaaatctttatacagccggtcaaatgaacggcacttcaggatatgaagaagcggctggtcaaggcttgatggccggcatcaacgctgctctgaagcaaacgggccgcgacccattcatcttggaccgcagtgaagcttacatcggggtcttaatcgatgacttggtcacaaaggggacgaaggaaccttatcggctattaacctcacgtgcggaataccgtttgatgcttcgtcacgataatgcggatttacgcttaacagaaaagggtcatgcattaggcttaatcaatgatgatcgctttgacagctatgaagtgaaaaaagcagccgttgaagctgaattagcacgtttagcaaccattcgcttgaaaccaactccagaaatccaagcctttttagcggctaagggtgaggcaccacttaaagatggtgttttagccagcgacttcttaaaacggccagaagtaaagtatgctgatttaatccaatttattccagcagtcgaaggcattgataaccgcgttgtggaacaagttgaaattcaaatcaaatacgcgggttacatcgataaggaaaaagctaaaattgcgaagttaaaacgaatggaagctaaaaagattccagccaatatcgattacgatgcaattgaaggccttgcaacagaaggtcgtcaaaaattacaaaaaattcaacccgaaacacttgcgcaagccagtcggattggtggggtcaacccagccgatatcgggattctaagtgtctatattcaacaaggtaagattgctaaggtcaaatagcctggttgataactagtcattagatatgttagagttaagcatatattgtcaatggtagaaagccagccgtttcacatgaaacggttggctttttagagtcatgaaagaaaagtgagggaatcaagtgataactgttagtgaaatgagcttaacgctttctgggcgtaagttatatgaagacgttaatttgaagtttacacctgggaattgttatggcgtgatcggtgccaatggtgcaggtaagtcaacttttctaaaattattagaaggtaaattacaaccatcatcaggccatatctcaatgggccctaatgaacggatgtcgagtttgaaccaagatcactacgcttttgaagaatttgaagtgttagagactgtgattcaaggtcataagaagttgtatgaagtgatgcaagctaaggatgccctatatgctaaagctgatttcactgaagaagatgggatgaaagctgctgatttagaagctgaattcgctgaaatgaatggttgggatgctgaatcagaagctgctcaattacttcaagccttagggattgatgaatctttacaccatgtgaagatgagtgaattgatggaagggcaaaagattaaggttttacttggtcaagcgctctttggcaaacctgatatcctattattagatgaaccaacgaatgggttggacagtgcctcagttgaatggttagaagatttcttagcagacttcccgaacatcgtgattgttgtttcccatgaccgttacttcttaaaccaagtctgtacaatgatgtgtgatgtggacttcggtcgcatcaagacattcgttgggaactacgacttctggttagaatcaagtaagttagctgctaagttacaatcaaacgttaacgctaaaaaagaagaacaaatcaaagaattacaagattttatcgcgcgttttagtgccaatgcttcaaaatcaaaacaagccacttctcgtaagaaacaattagaaaagattacattagaagatatccaaccctcttcacgtcaatacccattcattaagttcgatttcgaacgtgaattggggaatgatcttttacgggttgagaatgtttcaaaaacaatcgacggtgttaaagtgttagataacatcagtttttcagttaagccagacgaaaaagcagcaatcgtttcacgaaatgacgttgcgacagctgtcttaatgcaaatcttagcaggtgaagtgcagccagatactgggacagttacctggggtgtgacaagtcaacaatcatacttaccaagagatacgaactcagccttcaatgatgatcaactcatcatcttagactggttacgtcaatttgccgctaagggtgaagatgacaatactttcttacgtggtttcttaggcaagatgcttttctctggagatgaagtcacaaaagaaatcaatgtcctttctggtggcgaaaaagtgcgttgtattctatcgaagattatgttgcaaaaatcgaatactttactattagatgatccaaccaaccatttggacttggaatcaattacttcattgaatgatgctttgatcgatttcaagggtgctttagtctttacatcgcatgatcatcagtttattcaaacaattgcagatcatatcattgaagtatcagcgaacggtgttgtcgaacgtgctgaaacgaactatgatgagttcttagcacatccggaattacaaaaacaagttaaaaacctctacgtttaatagtagaaaaacgaaggcccctagtatagctaagggcctttttttattgttataagataattattatttatttacagaaaatccttgcatcacgggttgcaagttggtatactaataaagttgtcaaaagcgagctgattagtgataagcagtatcgtcaattaaataaaaagttttgaaaaacacttgttatttaattgaaaacatgataacatattatatgttgcttaaggagttataacttctaagtaataattaattaaaaatagttgttgacagacgataagctgtgtgatatacttaaacattaataccattacaagtaatgacgcatctgaaataaacagatataatattgaaaaaataatcgctattaaaatatctaatatgatccgtttaaatgttatctttctttgaatatatctatataatagaaaaattaataagatagcaacaaaattttgcattaaggaaaccgatacatccgtatataacatgctcaccaacaacctatcttaacgatgggtaaaaatttgtttaatcttatgaataaaattagaactatttcctgccataccaccgtttattttttgcaattctttttctgaaagttctttaaagatcatcatactttctcctattctttagtctaatcaaattatacataattcacaagattaacttattttttaaaattaacgttatcatttttatgattaacgttaattacggtttataaaaaataaaaaggttggcataaaatgattttatgccaacctttttattaggaatatttaactaatccgaaaatttatacaacacatataataagcaagctatcttaaacattaggtccacttttcctgcccaattactttcaatattcgatgaataaagtaagaagtgttcccctaaactagcaatgcctaaaacaattaaaactgctaaaaccggttgtgagtcgttcagatagacagcgacaataatgataattgacattaccaaagaaagaatcttttgataattctgaaattgattcagtaataagctcaaatgacatcctcctaatcacaatagttctcagtactttaattggccaactaagtctctgacaaactttattatggaccaagattcgatcaatattcaaaaaaaagattaacgtttaaaattaaacgttaatcgtcatagcgcttatttgcatcattgacaaataactaaaagggaactataactagtgtgaattattgtaatacggaggggtttaaatgacaagtttatcaattacaaaagaaaacatccatacactttacaacagtctaatggcgcatccggataaatcaaatgcactgttagatattaccgatgttttactccaggtttatcttaaaatcgacacggtaagtaatcccgaagcactcgtcaatcgtctcgcaaattatatctatagtgttggctttggtaaaattcatctcactaaggatgaggaacacttactaattgatttaggagcgtttggccaacgtgctggctggaacggcgtttatcgtggtgattatactgccaaagccgatttcttcaactacgccgatccacataaatacgctagaaattaaaagagtgtgacatcaaccgattatcttctgaggattaacacagaatggcgaaggattgcacagcaatcgtttgacgttcagggttaaccggaaggagatagcttgtagaacacgtttagagtgtggtatcagccgattaaagttcgaccatccaaaaagggattgagacaaaagcaacttttgtctcaatcctcttttttaaaccaatccatttccaatcccatgtaaccccgcacggttcacaattttgaagtcacctaatttgagcgttgtttgttctgtgaccaccgtttctaactgttcaatcgaaaatggcgatgtaaactggaagctatccccatattgatcaaaataactaacaacattgccaaaggcttgtttcaacgttgcagcatcaattggttgttccacagacatcagataaccgcgctgcccgttaccagtcagtgacgttgttgtaaagaatttaaaatagtctttcgtactcattcaacatccccccaatcttcaattattgatattatagcgctttcaaaatatgattgcattatctttcatcaattccattataattgcaattcatcaccgttacccctacaatctggttgtattactcaaaggagattggatcgatgaatactttattttatgcttctggtgctagctcacttagcgcacatatcttacttgagaagagtcggctgccctacaccgttacgcccgttaacttagatccccataccacatcacttggtgattatcatcagctcaatccgaagaattacgtcccagccttacaaactgaatcgggcgatttcatgactgaatgcgccgttattttagaatacattagccaccaaagtccgctgccactaatggcggactatgccactgaacaatactggcaacaacggatgtggttgaattacatcaccaccgaattgcataagaacttcatctcaccatttcgtaaaggcaattggctccccaatacacccgaaagccaagatttagtccgttcacgggttttcccacggctcgcttatattgaaaaagcgttagcgggccagtccttcttagttgctaatcaattcagtgctcctgatgcttatctattcgtcatgaccaattggtgtcgacgactcgcattttcattgactgacttccctaatctggaccgttttgatcaacacatgcgacaagatccagccatgcaatccgtcctcaaacaagaaggcaaaccacattcatcgaaagcttaaccaccaaaaaaggaatcagcagtcgctgattccttttttgatgatttacatcacattaatcgtgacgtcaatattgccacgagttgcctttgagtatgggcaaatttcgtctgcttttttgagatacttcattgtttcttcttctgataaaccgtcgatgtgaccgaaaagatcaacaccaatataataattggcagggccatcactgtaaagggaaacggtcgccttaatcgtgggttcgcctttaatatgttcttggttaaggacaacatctaaggcactgttaaagcaagaactatagccggctgcaaagagttgctctggatttgtactcttccctgatgggtctgtccctggtgacttgattacatatttctttgcttgatcgggtgaataaacgaagccattgcggcccccttcattaatcatcgttgtttcatattgttttgccatttaaggtccctctttcttttattgaatacccttactttagcacagcaaaattcagaaccataatgatttgtttatacaaaaaggcgccagcccaaaaatagattttggacttgcgcctttcttgttaatcctcaggctataactggctgattattcacactctatttaatataagccgtcttgtagctccattgtgcgccagctgtgttatgcacaacgcctttgacctttggattcttcaagtatgccgtatcattttgatagagtggtgtaatcccttggactttattcatgacttgtgcagccgtcacgaggtccgcccaacgtttgtcaggatcgttcgcatcggcattcattgcgcggtcaagggcagctttgtattctggattgtcgaagccatcggtattacttgcagcccctggtaacatgatttctaaaaacgaaattgggtctttgaaatctgccccccaacctgcgagtaataaatcatagtcgccttttttatcacgactcgctgaaacttggcttggcacggtctttaatgtcaccttgaagcctggcaagactttttcaagttgacctttgagatattgaccaacatatgacgcgttggcatcatcggaattaagcgttaaggtgagggcaactttcttttgaccagtcgctttcaatgcttcatgccaatgtttaagcgctaatttttgattgtaatccacggtatctggcacggcttgtgatttagcaaagtccaccttcttaggggaatcggctaagcccactggcacgaaaccagtaatatcgtttttcttcgaaccgaatagccggttattcaacgtcttacgattaatcgctaacgaaatcgccaatctaaagtcttggttattcaaaagtgcttttttctgttcatctgctgatttgaagttatatttaatgtagttcgtcaacgcataaggatatctatggaatgctttatcatcccgataattatcaatttgttgattatctaactgggttaaatccagtttcttttcctgataaagataaagcgcggtgctggtattttctaacacggtatagttgacttggtctaatttcacctttttgcgatcccaatattgattgttcttcacaaattgccacttctcactcgtcccattccagttaactaatttaaacggaccagagtacaccatgtatttcgcgtttgtcgcatacttcttaccatatttttcaaccactttttgatcctgtggggcaaataatggataagccatcaaggttttcatgtaagccacaggtgtggataatgtgacttccaacgtgtgctcatccactgcccgtatgccgagttggtctggtgccatctcaccttttgcaatcgctggggcattttggatattactgaaaaggtttgtataaggtgatttggtttctggtttcaatgtccgttgccatgaatagacaaaatcttgcgcccgaatcgggtcaccattactgaacttggcatcacgcagtttaaatgtccacgtcttaccatcagctgaaactgaactcgatttcgctaagcctggttcaattttaccgttctcaccaagccggaataaactttcataaatattccccgtttgaccatatcccgttgaagtcgagatatcaatggtatctagtggtgcttgcgcgccaagctgaagaacttgtttggcttgcacccccgaaacttggcataataagaacaccccgaatataaaaattgcactgacactaagttttaagaactgccgccctctttgcatgacacgcctccttacatttaataagtagagtataccaaatcatcagtcaaaagttaaataataagcctaaaaaaacgccgacaaaattaattttgccggcgcttttgctttaaacgtgctctgtaagtcatacccttccggttaaccctaaacgtgcttttcaaaccatgttcctgcgtttagcgctgtgaatcaaatcatcgactgcgtcgctaattcgcttccctgtgctaatgctcaaaagttgaccagcttgaacgcgctcttattcgaaacgtgctttcaaaagcatactgctgtgcttagctacacaagtcaaatgattgctttcagcaatcattcgccttgttaggctaatgctcgcagtatacccgcttttgacgcactctttagttcattatttcaaacaattgttttctgaattctggaccgtacatgactgccccgactggaatggcgaagtctagtgcttcgttaattttagtcgtccaggttggtccgaagcccccacagagttcaataaattggacgccttctgccttcaattgcttttagcgacttcaataattgaaccatcttctttagcacgtggatcgaacccaacggtaatcatctcgcacgttcccattggattacggttaatcatcgtattttgtttaggtgaaaagtctggtgaaaaatagaaaaacgcccatttatgcaaatttgctaatgccattgtttcgtcctccttgtttgctttcatcatagagaacaatcatgatagaggcaattttactgcctcttacagccagccattatgccgtgcaatctgaattgcttcaacgcggttgcttgcatccaatttgcttaaaatcgtcgacatgtaattgcgaaccgttccatccgataaaaataatgattcggccgcttgtttcgtactaaggccgttcgcaatcgcacgcaatacttccgtttcccgctcagacagtggattcttcgtttgcgttgtcagcccaacaactaattctggcgcataaacaactttgcccttcatgaccgaatgaatcgccacaatcaagtcatcactcgggccatcttttaatagataccctgtcacttcggcgctgatagcctacttgaaataactcggttgggcaaaagtcgtcaaaataatcaccttaatctgtggctgacgcgtatgtagttggtgcgcaatctcaagccctgtcatgcccggcatctcaatatctaacaaaacaacatctggttggagggtttcaatctgatcaagtgcgacttgtccattgacggcggttccggccatcgtcaaatcatcctctaaatccagaatgcccgctaaagcggtattcaatagttgctggtcttctgccaaataaagtttaatcatgcccttccctccatcttaagtggcaccgtcatcgtcaactgtgtgccccggcgaccatcgaccatcaactctccatcaatcgtttttaaccgttcgcgcatgcccacaatcccatgactcttatattgatcttcgcttttcaatccgcgaccattatcttcaatctgcatctgaaaagtcgttgcggttcgattaaaaaccacgtaacactccgttgcctgactgtagcgaattatattggtcacggcttcatgtaaacattgcgcaagcacttgttgattttgttgtggaatcccctcaagttggtcttcatttttagtcagcagtaaaatgcctgcaacgctgagattccgttcttgattgatcaattcctcagcaactgtcacttggcgtaaaccagcgacaatctcacgcaccatttttaaattctgacgggaggcttgttcaatctcgagtagttgttcgggtactgcgtccggttttttcgccaataatttgcgtgcatattccgcttttagcgtaatcattgaaaatgactgacctaaattatcgtgtaaatcccgtacaattcgttgccgttcgttctgcttaatcatatcggttaatcgctgattggtctgcgttaattggcgatttttccgattgaaacgctgaatcgagctagccgcaaatggtgaaaagatgcagaacaagccgtacaccattaagccaatcagatcatcgcgtcccatatgaccaccataataccaatatagggtgaccgctggtacgattaacgacagcagataggcacagtaataacgccagaaactacgccgccgcatgggaattgaaccaaacacccaagcggtatagatatttaaataaaacgcttgaataatgaccgccaagacggcactgctcaccatttgtaaaccaatccagaatggtcgataccgtgatgcgacatacccattgcgataagccaccaagaaaatcagaatcaaacccataattgcttgttgtttaaccgttcgatacggaaacgcgtaaccaattggaaagagtaagaaaatcaaccaagtatatgggaataacccatactggggtggcatggcaatgtagcgtttaaaaaaattcatgcatgcatcgctcctcttttatgatggtttaagtatacgacaattgccagtaataacccagcccagagcaacgtgatgccatattcacccaagtgtgcgggttgatgcgcaatcagcgcttggccaatatgattaatcggataaaccggcaaatgcttgccaatcacgcgagctgttttgggcattatttctgttggccaccataatccccctaaaattgctaaggggaaagctaacaaactagacaccagttgaatctgattttcatctgttaaaaatgaaatgctaatcccaattaaacaaagggggatgctggcaaaccacaaccagcccgccgttaataaccaactggaccacactaaatgaatttgattactaatcccagcaactatgaaaatgacgccgatcgttaaagcattgattaagcctaagttcaacaacttagccccataataagtccgatgactggctggtgataaatcgattaaggaaaccaagccatcccgcgcgtcattataaagtaatgtcgacaaagtaaacgtgttgttgagaactaaactataggtcgtcatactgaccatgtattgtcgattgaatgctgcattcatcacactttgtctcattactttcgtaaacaagagataaaacgcaatcggcattaagagtgaaaaaataacaaagcgtggattacgccaatatgcgcgtttaaagtctatttttgtttgtaccatcattgtttgcattttttagtcctccatcatttcgctataaattgcatttaaggagctcgcttgaacctgcacatcatgaacctggatccccatcattggtgctaattgacttaagatcggatcgctcttggtaacttgtaacagcacattggccccagtcttcgtcacacggatcacgcctagccattttgcaaaagtatctgctggtattttgataatagtagtctaaaaaagcccttttgccgtcttgtattgatagtcaccatcttcagtcaaaccaaaagcagaatccgttccgccggctctttcgattttagttctgaatagcacccaatctaccgactgaccgacgactggttcaaataattgggcactgttaaccaagaagtcatcggcattctcagcgtcaagttaagcccataaactaatcagtcataaaaaggctgcatcaaaattacttttgatgcggcctctggttcaagcatagactaactacgctttgtttgttattaatctaatttccgttccaactcactaacgatttcagcatgttttgcttccgttaatttaatcttagccatgaagattaacgctgaaataaccaataacaccattggaatgaagaacatgtacattttgaattgcaacaaccccgtgttagtgatatcgcttggtttcgcattcccagtcatgccagcatgaatcgcagccgtcacaacgacgccgtttgcaaaagccccggctagtttatccaataaaggtcgcactgccaatgttacagattcattccgtgtaccacttttcaattgtccgtattcaacactatcggtaatcgtcatcaaagcagccaaaaagaccagtggatatgggaagaagaataagccgaccgcaattaagactacgaccaagttacttccagcaaacaagaagaggatataaccaagcatcatcattgcgattccgccaatatagattgcccggcgatgaattaaagcaaccaatgttgggaacaacgcaactgacacaatccctaagatggcagtaatcacaccaaccgttgagaacgctgcggcgcggcccatgacatatctaaaataatataaaagcagtgagttcgtaatcacataactaaaggcaaataagaaatatgaaagagataaccacattaattggtcatttttaccaatcacactgaaaacgtcacgtaaccgaaccttttcagtattttcccgaatagcactcttttcttctttggttcctaagatggtcgctaaagcgcctaagaatgaaacaaggccaatgacaacggcaaaaccgaaccacccggcactggtttgttcactcccatgactcccagaaaatagttgcgagaagaaaaccaccattggcacgatcacgataatgaccccttgtgcacctaaagtggatccgaaacgcgcaatcgccccaaattttgtccgtttttcagaatcaacactcaacgctggcaacattgaccagaacgagatatctttaaacgagtagaagatatctaaaatcacgaaaacgattgcaaaaagaactaagtaaagataagggctacttgtcgcaagccccccaaagttggtaaaaatcatggccaagccaacagaactaataattgaccccgccagtaaccacggtttaaatttcccccaacgcgtccgtgtattatcaaccactccaccaatcagcggatcgaaggcaatttcaacaatccgaatgaccatcattgtataagtgacatacgcaatcatttttgaattaaagcctgcatttttggtatcgaataattgactcgtgacgaacatcataaaataagtgctaagtgttgcataaaaggcatcatgcccaaaggccccaaaagcgtaagaactatactgtttaacatcttttagttttttcatttctttagattcctttcgatagtttcttcattgtaaacatgctttcatcaagcacaaccctcgggttatcccgcttgatgacgcactctagtgatagcgatgttcgataattttttccaaaatcgcttggcgttgcttttctttggctgagccgaattggttttcttccaatgaattaaaatcgttggcgagtaaaactgattctagatataacgtcaattgacgcttgatataaaccttattatcttcattcgtttgcttgggattcccagcaataatcgctgcagcaaattggtctggatcgataataattttgttgtcgttcatcctagtcgcttctttctcttttagttagtaaacgtttactatttacaccatacaaataaatcaatctgtacaagagttatcctgtaaacgcattcttttagattgcaatcttattttactaaacttttagtaaaatgtaaacggttatttggaaaccgttacattcatcactggttacagttatgaatttaatttcactaaatatttatttttttattttttattgaaatttaatttcattagcgctatactgcatctatagaaaacgctttaaaaagaaaggagttgctttatgtttggtttttctatctatcttaatcaaccgttcacctcagcaagccgcatgaaccttcaaaaaatgcacgccgctggcttcacagaagtcttcacgtcgatgcatattcctgaagatgacatttcacaatacactgctagaatcaaagcactcagcactgcgtgtcgcgaagaacacttacaattgatgattgatattgaaacaagttcattaccagcagttggtctctcacttaacgatcccgccgcaatactgtcctttgggattactggtttgcgaattgatttcggcatcgataattcaaccattgctaagttatcacaatatttgaagattgccctcaacgcaagcacaattgccgaacaagatttagccgttttacgcgcagctggtgccaacttcgctaacatagaagcttggcataattattaccctagaaatgaaaccggtttagaacgaacctggtttactgaaaaaaatcagtggcttaaaacgcaaggtttaaccattcaagcttttgttcctggtgatggcattttacgcggaccacttgaagaaggattacccactttggaagcccatcgttatcagcatccgcttgctagtgcgctcgatttattcaactgtgaaacagataaggtcttcatcggtgatccaactttagcaaaaaccactctagcgcaatttgatgcattctaccatcaacacgtcataaccttgtacattcttaagtcagccccctgccccccttatctttttaaccaacatttccataatcggcgcgatgtcgcccgtgatgtcatcagattagaagaaggccggccactttgtcagaccacaatccaacctgaacagacatcagtacgattacgtggcagcatcaccctcgataaccaagactatggacgttatatgggcgagttacagattaccaaacatgacctacccgcagattctcgtgttaacgttcttggaaaagtcatccaaaaagatcacgcattactgccattcattcaggctggacaagccatccaactaaaggagattgattaatatggatttaagtcatttaacaaccgaaaaccgtaatcaaaagacaatgcaattggacgaactttcaattgaaaaagtactcacactaatgaacgaagaagatcacaatgtgccagaaagtgttaaacaagcactccccaatattgaagctgctgttcaagttatcattcaaagtttccaaaatgagggacgcttaatttatatgggcgctggaacaagcggtcgtcttggtgttctcgatgccgccgaatgtgtccctacttttggaacagaaccggaactggtccaaggtttaatcgccggtggtatgcaagcaatgaccgttgccgttgaaggggcagaagattcaccgacattaggtcgcgaagacttggaagcaatccacttaaccgctaacgatacagtagttggtattgcggctagcggccggaccccatatgtcatcggcggtcttgattatgccaaccaaattggtgccagtactgtcagcttagcttgcaacttcgatgccctcatcagccaacatgccacaattaatatagaagtcgaagttggtcctgaaattttaaccggttcgacccggctcaaatcaggtactgctcaaaaattggtgcttaatatgttatcaactgcttcgatgattggaattggtaaagtctacaaaaacttaatggtcgacgtgaaaccaaccaacgaaaaattagttgaacgtgccaaacgaatcatcatggctgcaactgattgtacttacgatgttgcggcaacccaatttagcgccgccaacgaagacgttaaactcgcaattgttatgattttaacggatttatcggctaatgaagccaaagaacgtttaacacaagcacacggttttgtacgtcaaactattcaataacaaaccttaaggaggcactattatgactgaaaaaaaagaagtacgcttagccagagaaatttacgccgctgttggcggacccgcaaacgtcgctaaattaattcactgtatgacacgtgtgcggatgacaattcgtgacgatgatcaagttgatatgactgcgttaaaagcaatcgatggcgttttaggggttgtcgaagaagacacgcttcaagtcgtcgttggtcctgggattgtcaataaagtcgcccaaatcatggtcgaccaagtcggtgttaaacttggtgaacccttcccagaaaatctcaccacaactgccacagccgcaacaatgaccgaccgcgaaaaagtcgaagcaaaagccgctgaagttaaggcaaaacaaaaagcaaaacaaaagagtacgccaaccaagcgggtcttaaagtcgatttcaaatattttcgttcctttaattccggttttcgtcggcgctggtttaatcgggggaattgccgccgttctatcaaacatgatggtcgctggatcccttggttcaaactggtctgaattcattaccatcttaaacgtcatcaaaaacggcgtcttcgcttatctcgcaatctatgttgggattaacagtgccacagaatttggtgcaactcctggtttaggtggtgtcattggtgctgttacacttctaagtggtgttgatcctaagttgccattacacaatatcttcaatggcgatcctttatctgcaggccaaggtgggattatcggtgtcatcttcgcagtttggattctctcattggttgaaaagaaattgcatcaatttattccagattcaattgatattattgtcacccctacaatttcattattattaattggggtcttcacaattttcatcgttatgccggtagccggtgtgatttcaaattcacttgtcggctcaattaattggattctgaatgtcgggggtgccttctctggtttcgcgctcggtgtactcttcttaccaatggtaatgttcgggctccatcaagtcctcacaccaatccatatcgaaatgatcaacaaaacaggttcaactttacttttacccatcttagcaatggctggtgctggccaagttggggccgcacttgccctttggattcgttgtcgtaagaataaagaactcacaaatatgattaaaggggcgcttcctgttggcttcctcggcattggcgaaccgttaatttacggtgttactttaccattagggaaaccattcatcactgcctgtatcggtggtgggattggcggtgccgtcattggtgcaatgggcggcgttggtgcgattgccatcggacctagtggcttagccttaattcctttaattacaaacggccatcaattcgcttatatcttaggcttgctcgcagcttatgccggtggctttgtcgcaacttatttctttggcattcccaaagatgctacaatgggaaaataacctttaaaggacgctgattttatggaaagcatacttttttcaattcaaaagaaactcccaactttaaccaaaacagaacagcggcttgctcaatacgtacttgcccatccagtacaagtaccgacaatgacaactagtgcgcttgcaaaagcggctaacgttagtgcagcgactgtcgctcgctttggtaaaacactctgtggtcaaggtggctttccagcactcaaattacgactttcatctgaagagaataccgatcaacggctcttcgatgaaattaatccgaccgatacaacaactgacttaaaaaataaactaacttttcgaattaaccaagcgattactgaaaccaatcatcggctcaagaatgacgcgctcgaagaatccgcaatgattctccactcgaaacaaaccattttcatttatgggcttggtgcttcaaacgttgccgctgaggatttacaacaaaaactactgcgcgttggtaaatctgtcattcaatcacttgatacgcatctactggcagcagcactaaccacacagaaaacacaggcagcacttatcttaatttctaactctggcgaaaaacaagagcctctgcaacttgctaaaattgcacaacaacttaatattccaattattgttttaactcataataatcaaagtcaaatcgcacagttagcaaccatcacgttacagcatgatgatagtactgaaaacagtcagctaagaagcgcggcaacgacttcattaattgcacagctttacgctgtcgacctactctattacagtttcttagaacaagatttcaccgctaatacgaaccaattagctgattcatcgaacgttatcagcgaatattttactaagtagaaggagtcatcattatgaaactattctcacgtaaacccaaagaactcgaattacacgctattgtagatggacccgtcatcccgctcgaacaagtaaccgacgccgttttttcaacaaaaatgatgggtgatggttttgcagtaaaccctagtgatagtcatatctactcaccagtggacggtattatctctagtgttttcccaacaaaacacgcacttgggattacaaccaaaacgggcgttgaattattactccaccttggcttggataccgttgaattaaacggtgcgccgttcaccattcacgttcaagaaggcgatccggtgacaacagaccagttattagttgaaatcgacttagctgcgcttgcttctgcgggtaaagaagcaaccagtatggtgattgtaaccaacatagacgatatcagcggtgttaatgcccccctaacaactagcggacaccacggtgaggttgcacaaatcattaacttataaaaataatatagaaaagccccgctcagatgagcggggcttttctatattatttggctaagactgttatttgattattataacgtgcttgattatcaaactgcatcaatactttagtcgctagatcttgcgttgcaaaaactaatctttcaactggcgtatttgccacgttgtaagccaccatgtgtgaaaaataaacaaactgtaacatattgctgtatgccgaaacatcgccttgtttcacaatttttttaacgaaaaaattaacgatatgatcaccaaaacgaacataacctggaatcgaaatcagttgtacgttggactgtttagcagcccacacacgattggccgcgttatctggcgcgtaaatctgagttagctccatcggatgaacagtcggttgcatggtgattaaagtagtttgagtcattacttgaaactccttaaaataagatactatctactataccaaaaaaggcgccctctttcagaaagacgtctgtcagttacttaacctttcgcgcattcaatcccataccgcactaacagatatttcttttcacctaaataagggggactccaatgttggagtccccctttacttttaattaaaaaatattcttcgttataattatttcaatagtgtcttcaatgatactttatcgttctgaggcataatctgaataaaagcgtcgacacctttatccatcaatcgtttaaatgattcgttttcctctttgtttgttgaaattgtgtgatacaaacgttctcggtcatccttagcacccataccgcctaagtcaatctcttgaatattaataccgtggtcaatcatgtattcaaggacttgcggggttttagctaaaataatcgttggtgcttcgagtggatctgaaaagaaggttactccatcttctttagagaatatcccaattgcaatattatctggaacagcattttccaacacatttatcataaaatcatcctgtgcaacaccgtcatcaataattacaacctgttcggcatttttatttttaatccaggctgtcataacttgtccgtgaattaaacgatcatcgattcttgttaagactaagttttccatgctttttctctcctttaaactctaattcaatttcttccacaagatagctttagcaatttcattcatactattaacttaataactataacaaactcttcattaaatacaaagattaatcggtattacacgcttctatatttgttgtacaattatctcattacgagtccaattgaggagcacccattcaatgcagtattttaaaaccctatttacaagtacattcacttttttaaagcagtcccaggcctattttcgtagtgtgttattgatgcatggctttttgcttttaatttgtctaccgcttttgagtaaagccagctacttcattctggtacataatcagatccagtttctcgcgttgagcaacttgccagcgcttattcatcagcatccgattgcgctgttagcactcgtaggaattgcgctactaattttattgctggctttcttcgaattcacgtttcttctgttaagtgtgtactttattcagattaaacggccgctagctttgcaggcattgctgaagatgacttttgcgcaactcaggcaccttcgaattggcacgttctttttctttctatattattgtcttttaattttaccgctgggcgggcttggctatcattctgatttattgactaagtttaaaataccggcattcattctggattatattctcatgaatcggcgaattgtcgcgggacttttcattcttgtctatttgggcttattatatctcggcttacggctgatattcaccctaccaaacatcattcttcagcagatgactttcaaaaaagcgttgaccagtagttggcagtttacacatcaaaaaattggctcattactggggcgtctactcttaatcggtgccgcactgattggctttacgggactcacttttttcctactcatccaactacaagcgttgattgaaacccacacatcagtgggactgccaagtgccgtggtcatcatgaccttgttgcaagctgctatgctcatcaacttggtgctttcgacagtcgccgtctttttcatcgtcattgattatttgttggccgacccacaatttgtgcaaccgacgttcaactatgcaaccttaaaattaagcgtgccgctcagtggtcgttggttattattcgtagcaaattgcgttttaatcggcgttgggacttataattgggactatctccgttcagtaaccattcagcagccgctaagcatttcccaccgtggcgtttcgcaaaaagacggcgtccaaaattcgattagtgcgctgcgaaaaactacccgattaaagcccgattatgttgaaatggatgtgcaattgactaaagatcaccaattcgtcgtctttcacgacttccaacttgccccactcactgggcactcagggaccccgcagtctaaaacactggcgcaactgactaaaatgaccgtccatgaacatcggcaatccgcaccaattgcttcatttgatgactatcttgcacgcgccaatcagcttcatcaaaaactactgattgaaattaagacacccaccaccgataatcccggcttggtgcaacatttcctgaataagtatcaggccaatatcgaagctcacggtcacatggtgcaatccttaaactggcacatcgtcgaggccgttaaaaaggcagcaccgaagattcaaacgggctacattctcccctttaattttatcggcccaccaatttcgaacgctgatttttatgccgttgaaatgacaactgtcaacagtcacttcattcaagctgcacatcaggaaaataaggccgtctttgtctggacacccaatgatcaacaagccgtccaacgcatgatgtatttcggtgcagacggcgtggtcaccgacaatctcaccgcggttaagcaagctaaacaacaaaataaccaacaacactacgccgataaactcgcatattatgtgatcggtattgggtaatatagtaaaaaaggattgggaatcgatattttcatcgatccccaatcctttttttattagcgattctttctaagccaacgtcttacacttgaatagccaagcgtaagccctgttaagagcaatacaccagctgaatacacgaatccaatgacaatcaccgtcttcatcaagcctatttggcgaaccatgtcagcacaaaaagcagccatcaatcttcaattgacaactgcttgcactttatttgtctaaaagtcgttgtgctttttgggcggcgacgttcatgatgttccaaggacggtcaaaacctggttggaagaagaagtcagcgtatgctaaatcatcgattgtcatcttaccttgaatggcaagtgaaatggcgttgatgtttgccgtcacgtcagctttagacatgatttgcgcaccgagtacacgccgtgtttctggatcaaaggttaatttgaaatcgaccactggattttctgcttcagggacgaagtgtgggcgatatgtttcagaaaccaaaacagattgggtcttcacacccattttatcagccgttccttctttaatcccagttgaagcaaagtgataatcgaagacgctcaatgctgatgaacctgaaacagcgggtaccggttggttggcggtgactaagttcttagcagcatagcgaccttggcgacgcgcattcgttgctaaagcaattggcatttctttgccagttggtgcgtatttcacaaccgttgcatccccgactgcaaaaatatcgggttggcttgtttgtaagaattcattgatttcaatccggccgctgcggtcgagttgtaatgtatcttttaaccagcctgtgttaggccgaatcccagcagcttcgatgactaagtcagcatcgtattcagcttgatcggtcacaactttagttagcttaccgtcaacgccgacatattctttgacgccttgaccaactgcaggatagatattgtgcgcttgcatttcagccgttaattgatctgtaaattcttgatcgagatagagacttaatagacgtggcaagacatcaacaactgtaacatgtttgccagctttagcaaatgcttcagccgcttcaatgccaatataaccagaaccgatcaccacaacatttttaacggttggatcaactgtcttcgcctttaatttaatcgcccaatcacggccacgcattgcgtagacattctctaaatcacggcctggcactggtaattcaaatggcacagcgccgacactcaagactaacttatcgtaactttcttcacgcgttgtattattctttaaatccttcacttggaccgtatgttgatcggcgttaatcgcggtgattgcttgttgtaggttaacttcaaccccttttgcccgcatgccttctggtgtcgcataactgacatcattaacgtttttgacggtcccttctaaatagagttgcatcccgcaggataagaacgataggaaatcgccttgttcgtaccattggatggttgcatccggataatcgagtaaactttcttgaacagtttcaaatccaccatgagatgaaccgacaacgataattttcacattgatcactccttattctatgttacacaacccaagtataacgcagatgatattaattacaaataaaaacgcattctcggatgactttcaactgaccattcttaaattccatgctagaatagtgacaagctttacaataaaaaacaatggagattgctatggcctttaccaaacaaaacttccccacttttatctatctagcaacactttatctcacctatcagattctaaatactttgattcgcatctttaccagtaacgatattctcgtctacgccaaagaatcatcaactattttcatcgttttcttcggtattttctatttctcatatatattgttcggcgttggcttattatacgctggccacgtcatttcgaaacaatcgggcaactacgaaatttcactcatgattttaaacatcctcaccacttttagtaccctcaccacgattattttaaaattttctggggcgcagatgccgcgtttcttactttcaaccacttttttcatcattttgaccaccatctcgttagccacaacttccaaactgctacaactgcgcaccaagcaaattgacaataagtgactgccaaaggtgaagtagcgcctttttatgttaaggagacatttttcatgaacggtaaaattgattactaccaactctttcaaacaatgtatcggcaatatgggccgcaacactggtggtcttctgattcccattgggaaacaatggttggcgcggttctagttcaaaatacaaactggcaaaatgttgaccgctcgctcgccaatctacgatcaagtacgcacttcgagccaaacaatctgctttctctttcggatgaagcccttatgttggctattaaacccagcggcttcaataacgctaaaagcaggacaattaaagggctgtttcgatttttagcgacagttgattttgacttagccacgctcaatcagatgacaaccaccactgacctacggcgccagttacttgccatcaaaggcattggtccggaaacagccgatgtcattttattatatgtcttcgaccgcccagtctttatcgctgatttatatgcccgccgcttaattgctaacctagagcactgttctttaaaagacctccactatttaaaggtacaacaggttattgaaccacagctcttaccccaaatgactgttaaagactgccaagaatttcacgccctaatcgacgatcatggtccagcctttcttgcagcacaaaaataagccgacatccgtttttagacggacgccggctttttaattacccaacaacccctttgcttgtatcagctgggtggaagagttggtcaataatacccgaaacgcgggttaaatcaacattcccgcctgaaactaaagccacaatatttttatctgttaaccattgaggatcaattttaccactcagcagtgctgccgttggtaatgcaccagcgccttctgtgacaatcttagtccgttgcatgagatccttcatcgcagttgcgatttctttttcggaaactaaaatcatttcatcgactagattttgaaccactgggaaagtcagttcacctggaatcgcaacgtctgtcccatcggctagcgtgaagtccgcatgatggctggtgattgtgcctgcttcaaatgaagccgtcatcccgtgcacgttttccgattgaaccccaatgatgtgaattgaggggttaaaggatttcaaagccgtcgcaatgccggagattaagccaccaccgccaaccggtacaatcaccgtatcaacattccaaatcgcatccaaaatctcaaggccgattgtcccttggccggccatgacttcgcgatcgtcgtagggatggacaattgttaagcccttttcggctgctaactgctccatgtacaaccgcgaatcattaaaagtcgtaccatgtaaaacaacgttcgcaccataaccggcggtcgcttgttgcttagcaagcggtgcttcttctggcatcacaacggtcgcatcaatccctaataacttcgcggtcaatgcaaccccttgcgcatgattgccggctgaagctgtaatgatgcctttagcccgttgctctggcgttaaatggttaattttattgttcgcaccacggaatttaaacgatcccgtcagctgcatattttccaatttcaaatagacatgaccgtgcgccacattacgactcaagaacatcgattgaattaaaggtgtttcgcgaatatacggtttaatggttgcccgtgcttcctcaatatcccggatatcgcaaatgtctgcggtttttaatactaattgattcgttgccattctggccacctcttccatttgaattgacacaaatgtctgcggataggttgtgctatccttcacaattaaatgtaagccacttatcaagcattgtcaaaacaaaacggccttaaattagaacgcttttatttggtggttattaagttctcattctagttgtttaaccagcaagatagtgatagaataccataaaataaagtgatgaggtgctcaacatgaacgaagcaattttagtttcaactagcctaccactcgtcatcggtagtggttttggacacggacacaaagaacaacaattcgttcagcaactaaacgtagctttgcaagctgctaagatgaattggcacgtctctcttgatgatacttttggggatagccaagccattcaccaaaaacaaccgcaagctttaattctcaaaaatggtcttcagcaccaatttaatcaaagtaattttgactcaaaccggatttatcaactcgatgcgctagcgttatcaaccctgtcgacaaaagcagtggttaactttttagcgaaactatcggcttagctcaaaaaagagcgtaacgctatataaacgttacgctctttttcactaataaccatatctaatcgtcgacaacgccgtcatttcttttaacttagcttgttgactggctgatagctgcaagccttctttttgaaccacattcgcaattgcaatgttcatccggcttaaaatgaatggcacggctgttgtttgtgcttcaagttcagcttgatagctgttactgcaatggtaccgtttggtcatcttgtttcaagtcagttaataacgtactgattatcgtaattgcttgattcccccgttcctgtccacctgcataccacttcatatttgctcactccccattttaatgaaaaccaccaaaggttatcgagctagcaattaaaccgtagcccaaattaaaatcgcgcagtctttttcgatcaagttttattaatttctgatggatatagccgtatagattacgattttcctgcggcaatgtcagtgggacgatatagttttcatggtaactgttatagatccctaaacaaacgttgaattcgtccgtcccatcaaccaactgctgagcagctttcaataaattagttttgtacggttgtggttgattcgttaaatcctcattgtaggctttatcaattaaatcgaataatgtttgttcactctctgtcaatatccccaactcctttacacagccattatgacgcaaaacctaaatttaagccaaaaaaaatattaacgttcaacttctttcgatgaacgtcaatattcaaatcgccatggcttagataacaacttctattctgttagtcaatatttaataatgcctatttaagttgacgccttaaaaagaatataacgacaacgttattaataattgctactaaaattaaaagatagaatattgcatgatattcttgatcaagaatagcgggtagcaataatatggttatcaataacaaattcgtagtttgggttagccaataagcaacacgcttgtttagagacacccgttagcccccatgtaagctaattctccgccgataccaccagcagccattccccagagaccaccactgactccggctcctaaaccagctgcaccaactacacatttaccaaagctagcacgttttcctccaagaatttgttgtaattctactacgcttagttcttttgtattttgcatatctaaaatctccttgtaatagtattttatagaatacatatatgctggccagctaagtacgctataacaccattatgcttcaaatccctatttaaagacaaaaaaattattaacgtattaatttaactgttaaacgctaatatcaattttcaaattaattttaaaccaagggaaaattcggattaaatttgcaatctaccacattgcaacaatccttaaaaattttgcaatctaatagtctcgacctactggattatttaaaagctcgtagtttagagaaccccttgtttgaggtcgggtccgtcgaagcctgtacaaaagaattcaattttgatcagctagcggctcacggaacaggtaatttatacgattatttgttggaacaagtcggttatcggtttaaagcaggtaaattacagcaacttttgcaacggctgattttggaggttgaaccaaatggctatttaaaggtggatgaagcccgttttatccaagaaaatcaaattgatcagaccacttatcaagacgttgtgacgttactacaacaacttgatccaatcggggttggtggtcgtgatgcacaagaagtgttattactacaggcctctgctatttatccggctgatgatcttagtattttggtgataactgattattttgaacaattattagctggtgatattaaataaattcaaactcagttagccattagtcaagatgacatgcaatcgattttacacaaaataggtgcactgagtcttgaaccaggaaatatgtttgatgactcaccaactaattttcaagtgccagatgtcattattaagatgaatggctcacgatatcagctactattgactgaatttgggcgaccaacgctgatttttgaacatgcaagttacgcgcagttccaaaaagaagtcgatgtcgctaccaaacaatacattcagcaaaaatatgccgagtatcagatgttaaacacgagtttgcataagcgcgggcaaacattattaatggttgctgaagtcctaatcaaggcacagtgggattatattactggaaaacaagcatatcctaatcaattgattctacgggatatcgcaaatcaattgcagctcagtgaatcaacaattagccgaacgattaaagaaaaatcaattcggacgcctaatggtatctatcttctgcggaatttgttgaccaaacggagtacaactttagaggaaggtcccaccttgacacagacgcacattgcaattcaaacagttgttaaggaagaagaagcccatcatccattgtctgatcaaaaaatcgcggaccagttaaaagttaagtatgacattaaagttgctagaagaaccgtcgctaaatatcgtcaagaattaggtattgctaataaggcagaccgtaaataagcaaaaagcaatggatgcagttaatattactgtatccattgctttttaggttcttataaaattgccatcagtttaaaccagtccaatacaagtgggacccactgagctgctacagtattagcatattctggtttgcctggtgtttgagtcacatgattagcaagcgaaaggccatgaacaccagctccaaagagatggtattcaacagggattttatgttgctgtaatgcaagtgtatatagaagtgaattcgttgctggaacaagggcgtctgtggctgtttgccaaataaaagctggtttagctgctgctgtgatatttttttgtgcgtgccataaagtttggtccactgtaatctgttgcttagttgcatcatcaattggaaaaccagcgtcaaaatcaatcacaggataatttaagacaatcgctgcatgatgaccacggtaatcgtctaacccgtaatcagctcggtggattggatcggtcgcaatgccattataggtagcgaccacatgtccaccagctgaaaaaccagtcaaaacaattcgatccaaatcaatatcatattctccagcttgatcagtcacccactcaattgtcttagcaagctgatgtaaagcgagcggataaacggtttcagtcgaacttattaattggtaggggagaacaatcacgtgaaacccttctgctaaaaatcgcaacgcgaccggtgttgtttcacgacctgaatgatacgtaaaaccaccgcctggacaaataatcatgacgggatgtttaactggatgctcgaaatctggaatgggtgttaaccaatatgcatcaactataaatgcttgttctttaacggataacgtttgacgttcgatcgacattattaaggacctctttctattatattaaccgttttcaatctatgttaatcttaccggataatgacaaaaaataacagtattaagcatgactttttgatactaaccatttaaaaatctcattaagtaaagtatgatagttttagaggaaaatgtaatgatatcagattatacagctctttacggcttggttgcgcatccagcgcaccatagcttgtcacccatgattcataatctgggttttaaacaacatcaaatcgacgcgcggtatctggttttcgatagccaagcacggccgcaagatgtcgcaaaagcgattcggacgcttggtgtggcaggcgttaatctttcaatgccctataaacagtcgcttgtgccattaatggacgagttaatgccaactgcgcaactcgttggcgccatcaatacggttgctttacgatcgggtaaattggtaggcacgaatactgatggcgatggtttttggcgcgctttgcagaaaagatatcccaatctagctagtcagcagattgttattctgggtggtgggggcgctgctctcgcggttatcgaagccgccgctcgctatggtgtggcgacgattcaggtcttcaaacgtcaaaatacgacttatgcggtggttgaacaacgactggcaaaaattgctaatcaccattcgatgtccatcgtgctacataattatgccgatgaacaggcactccaacaagcactcagtaatgctgattgcgtgattaatgccacgaatcttggcatggtcaatacccctggattaccgctggcagcacctttaattggtcaaataccgatgacttgtttagttgccgacttaatatatgcgccacgtcagactgcttttttacagttagcggctcgaagtggtcatccaacccaaaacgggcttggcatgttagttgaacaggccgcgttgagttttcaattctggacgggccaggtcctacaaaccgatcccatctatcatgctttaacgaaggagttttaataatttatgattattcaatttaaaccaaatactgattcagcgctgattgatgatttttgcgcacgacaacgcacgacaaatccgaatgtctatcagattaagcaccatgtagcggtgatcggtgcaaaagcaattgattttaccccagcagaggaagaagtcattgcggcaaccaccacggatgaaccgagttacgtgcttggcagtcggctattccaacccaaaaacacggtcatcgaattagcacacagtacgattggcggtgcagacttcacggtgatggcgggtccttgttcggtcgaatctgctgaccacattatggcgatggccaaagttgctaaagaaggcggtgcgactattttgcggggtggcgcgtataaaccgcggacatcaccgtattcctttcaagggatgggcgaagctggtttgaaagcattgcgcaaggctgctgatgcttatcaaatggacgttgtgaccgaagtgatggatgaaacgcatgttgatttagtggcgcaatataccgatatttttcaaatcggggcgcgcaatatgcaaaacttttcattattgaaagctgttggaaaaaccaacgttcccgttgctttaaaacgtggcttagcagcaactgttgatgatttattaaatgctgccgagtacattgctgccaacggtaatcaacaaattatgctgttagagcgcgggattcggacgtttgacaatcactatacgcgcaacacatttgatttaaatgctgtcccagttttacaaaaattaacgcactatccagtcttaattgatccgagtcatgcgactggtgaatgggatcttgtgacgccaatggctcgggctggagtcgcaactggggcaagtgggttacaagttgagattcatgatcatccagaaaaagccttttctgatggcgcacaagccttaaagccagctacttatcttgaaatgtgtcatcaagtgtgggccgttgatgcgatcgtcaaacagtggcggcactaatggtgataattgatgtccacctcacacaaaaaaattatcagattcggatccaatctggtttgtatcacatctgtgctgaacaaatcgcgcaagtttggacacctcgtcaaatcgcattaatcacagacacgaatgttgccccgttgtatttagaaacggtcgaatctcaattaatccaagctggctatcaagtcacaccgattattattccggctggtgaaacgtcgaaatcacttgaccaagcaatggcactttattcccaactggcagcggcgaattttacccgtcatgacggggtgattgctttaggtggtggggttgtcggtgatttggcggggtttatcgcgtccacctatatgcgggggattgcatttattcagatgccaacctcgcttttggcacaagttgacagtagtgtcggtggaaagactgcacttgatttaccagctggcaagaacttagttggttctttttaccagccggatttagtattgattgatcccgactttttaacgtcgctggatcaacgccaattactggccggttatgcggaaatcgttaaagtggctgcactcaacggtgggacattttggcaacaggtgacagggattcaaagtgcgcatatgattctagcgcaggctgaaacactaattcagcaaagtgtgcactacaaggcacagattgtcatggccgatgaaaaagaaagtaatcaacgccaattattaaattacggtcatacgattggtcacgcggttgaaaccctggccaatggcagcctgatgcacggtgaagcggtcagcatcgggttagttgccatgcagcacttagtcgaacaaagtggactgactgaagcgcatttaacaccagtgattacaactgttttaaatgcggtcggcttgccgacagatagcccgttacttatgagtgatcgactcttcacgcaacttttacatgataagaagaatcaaggagatgccattaatcttgtttacctcgatgcaattggtgttccaaaaattcaatccataccgctaacgactttagcggctaatctattttcaaaaaaaactggtaaccaacccacagataccttacaatgaaactaacttgtaaagagtgtttaactgaccgtatgtgcggagcagtcttggaaccaacaatatatttgaaatagaaccataggggttgattgactagatgcaactgattttaatcggttttatggggtctggtaaaacgaccattgctcgcaaagttgcacatcattaccattgtgactggattgatttggatcgctacatcatgcaagaacagcaaatgacgattaacgaaatctttgccgaaaaagggcaggctgcatttcgacaaatggaatttgaggccttacagacattgatccaacacgatgggattatcgcaaccggcggcggggtcgtggatgatgctcagacgcgccatttacttgaacagagtcatatccccatttttttcctaaatgggagttatgaagcacattggcgccgcgtttcgcgcaatgatcggcggccacttgtgaatcaattgggccacgatggtttacgcgaactgtatcacaaacgacgaccaaagtattatcggcttgcggactacaccatttttttccaacataagacaccgaacatgatgttggcagaaattgatacgcagctacccaggattcaaaaaaagttggctaataaacattagtcagcttttttcaatggtcgtagaatcatattattcgctttttaacgccatagacttgtatgatgaggttataacaaggagggtgaacaatgacatttaaattaccagcactaccttatgaatatgtggccttggagccgtatatcgattctgaaacaatgcatctgcatcatgacaaacatcataagacttatgtaacaaaactcaacgcggcgctagccaagcaccccgatttagcaggtaaatcattacatgatttgttgacacacatcgatgatttacctgagaatcttcaaacacctgtccgcaataatgctgggggccatgccaatcatagtttcttctggcgaattctaacaccgaatgcgccagaagcaccaacgggggaattactcgaacggattgaagcccgctttgggaagtttaagacgttccaagaagcattcaccgaagctgcccttggtgtatttggctctggctgggcatggcttgttatcgatcaaaatggtgaactacaaatcatgacaacgcctaatcaagattcaccacttatgagtcgtaatcgaccactacttggacttgacgtttgggaacatgcgtactacctgaaataccagaataaccggattgattacatcgaaaacttttggaagatgatcaattggccattggtggcggaattactttaataagggtgttcattataatacatttataactgaataaaataagacccatcacttaataagtggtgggttttattttacacaattgtaaacactgtcatcacagttatagagcgatttattcttaaatgtaatagttgtagttatcattattgacatttttaatagacaattttcagcagtccatgctaatctgaatatgttataaaaataataatacttttaggggatgagactatcaagaatgtaatcggaattttagcgttaggaatcctaacaactagcaccatcagttctatacaaacagttaaggctgaaccaagtgacaatcaccaaaatttagcgagtagcgtgctagcagatagcctcaaatccaaggtgaggcaccagcaaactctaaaagcaccacaagaaatgaaaacctatattggtcgtggtgatgtttttaaagaaaaagaacggcaacgcagaacattacgctactcaagtttagagcctagcggtttatacgcccaaaaaggggatgttttgacagttgctcaggggatgcaagattcattatctatcacaattggttcgcccgaacgagaaactcaaaaacaatatccattaacaaagggcattacaacgattaccgttgaaaacgagggcccgatttatgggttttatgccggtaagacagccaataggcttggaaatcttttttgtcgtaagtctattggttttgtggacgcaccgtttttttctgcgaactaagctgaggcgtcgctgtttttgctgagtgtttctgacaggctgttagtcacaataatgcaacggtcagcgtcaatgttagccagagatgcctgattttcataagatagtccttcacagtttagtttaccccgataattataacagttacgcctactttgactagtcttaaatattaatttttatcgaaaaacgataaaaattaattgtttttcaataaaaaacgattataataaaactattcttaaaaacgaggtatcagatgaatgttaaaaaaatggctacttagaatggcattactcggaattgcggcggtatttggtctgttaagtttgttagtgacgatccaaattgtgaccacgaaacacttagaatacccagcgacaatctggatgttggcgattgctgcgtatggtgtgacggctagtatttggtttgcattaatcaagttggcgcagattctccgcttaattgagcaccatcaagtttttctccctcagacgctacgatatgtatcagcaattagaaaagcgattttggttgcgagtttgacggccctttttgccctaccctttttctaccggattacgcaactcgaagatgcgccggggttaatgttgcttgggttgggcctggtcttcattccatttgcaatcctcattttgatgcaaattgttgaagatctttttaaaagtgcaatcgcccttcaatctgaagtcgatttaacggtctaaggaggaactcaatggccattcgtgtgaatttagacgtaattctcgctcaacggaaaatgagtgtcacggcgcttgctgaacaggtcaatattacgattgcgaacctttcgaatttaaaaaccggtaaagccaaagcaattcgcttttcgacgctcgagaagttatgtcgcgtattagactgccaacctggtgatattttagaatatagcgatgattaatcctgcggcccccttttatcggggaccgcttttttaatgcttcagtacactggttgatgcgatatgtagtataataaatccgtagtgattatgaaaggggttttatgctgatgtattacgttgtgatgaagtcaaatgatattcgccgaaacttggcaaccgaacaatatttaatgaatcaaaaaaatttcgatgagccactcttactattctacattgagaaaccatgcattatcgtgggccgcaaccaaaatacgtatgaagaaatcaatcaaaaatacgtggaagaccatgatattacggtcacacgccggttgtctggtggcggtgggatttatcaagatctcggtaacctttgtttcagtttcgtggtggacgcagattctgaacaattcggtgatttcaaatccttcacgcaaccaatcgtcgatgcacttcatcaaatgggcgccacaacggctgaagtttctggtcgtaatgatatgttagtggacggtaaaaagttctctgggaacgcgatgtacaccaagaatggtaaaaccttctcccacggcaccctttcatgggatgttgatttagatgttttgacccaagcattgaacgcccctgcagataagattgcgtcaaaagggattaaatcgattcgacaacgcgtcacaaacctaaaagggcacgttgatcctgaataccaaaatatgtcgacagaagagttcagagacgtcttattactgaacttgatgcacgccgatcaactagctgatgttgccgaccgcgaatatcaattaacggccgcagacgaacaagccatcgataagatttttgacgatctctatagcaattgggactgggtctatggcaagtcacctaaatcaacgattcaaaaacgcaaacacttcgatttcgggacgattgatgcgcgcttgttaatcgaaaatgggaagattgccaacgtcaagttctacggcgacttcttcggttccggtgatgctaatgaattggctgaaaaattagtcgggacggtttatgaccgtgaacacttagcaagcactctcgaaccaatcgacaccacgccctacttcacagggattccaaaaacagaattagttgaattattagcacaataaaaaagagtgtgtggcggaacccggtgatcccctgagggttaaccgcaaggatacgggttacagaacacgtttagactataaaagttcggctatcaaaaaagagctgagataaaatttacttttgtctcagctcttttttgattttatgcgatgatttcagtatgattacttataagtaattagaaatgtcggcgattaaaccgccaattgccgagccagaggaataacacagcataaccaagtgtgccaagcaataattggccattggtgagttgtgtcaacttgtggtaaacaggataatttgcgtattggaatgtcagatttaacatgttgaatggattccacctaagccaactgccaaattgtgggtgttcatggagtaacatacttgagagcgcttggcccatgaatacgattataatactcgtcgtgacgaccaccgcattatttgtcagcaaacaagtcagtaagaataagcagccaatcaatatgagcgacatctcgagatcaatcgtggcggtcatgatggtgttcatgagtaaactttggtggtactgataaggtattagccaatttgcgtgcccaccaatcgcaagtgtgttaaacaagattgtgagccccaatgcgaatagatgcaatgtaatattgtagccaaagagaacaacgaatttagctaaataaatggtccggcgatttggtgctttgtaaagtagcgttaagctggtattatgctgaaattccattgagaaaaacgtcgccccaacgataatcaacacgagtaaaatccattggcttgaaccaaaattggccattaccaaccaattagggtcgttgaaggttaaaggcattaggagcattaaacctacgataatcccaggtgcgaaccacgttaatttttgatgcaacagtttgtaatattcttgagatagtgccgcttgcatatgaatcgcccctttctaaactcgtttgtgtttgaagcgccaataaccaatcgctaggaaaaagccactataaccgatcgcccccacgagtagctgcacattacttaagtgagtgtctttttgatagcttgaatctggtagttgcgccatcaagttaagcatgttcaatggttgccacttcagaatagccgtcaacatcggattagcgtcgattgtaaggctggcaattccctgcccagtaagaactaaaatcaatccaaggccaattaccactgtattgattggaaagagacacgccagccataaaataatcgttagaagcaagattgcgaccaagaatgtcccggccattccgacaagcaagtgactgaacaattgtccgtcctgccaactcagttgtggtgcgaacacaatttttaaaagaccggtgaataataagctaaggaggactagtacaccagtgtagagactgagaatcagcaacttagcgagataaattgaccaccgataagtgtggcgatacaaaagcgttcggattgtggtgtgttggtcttccatgatgaaaaaattggcaccgataatgacgatgatcatcaacaaccactgtggtgtcccaaagcccatcacgactgcggattgagtaaccggtgctgaaagcgccatgatcagcattaaacctaagagcacaagcaggcctaacaatggccccggttggtggcgaaatttataccattcttggcttaagctagtttgcatgttcatcgccgtccttttcgtggagtaattggacaatccgttgttcgaagctaacttgttctggaatcaacgccttgaattgaatttgctggttgaagcacaaggtttgcaccatgtagagcgcggcttgagcgatgtttagataaccggcatcttgctcaaacggaatttgctggtcagttaataaagcctgggtttgcaccatatcagtcgtttggaggcgataacgttgtgcggttacttgattaaacgttgcgattggttggttcagacgcacttgaccgttattaatgatgatcacatcggtgacgactttttcgagttcactgagaatatgactcgcaactaaaaaggctgtcccctgttgcgcgtattgttgaatgatttgccgaaccaaaatggttacatcgatgtctaatccatttcattggttcatctaagataactaattgggggtgatttaataaagcaagcgcaattccgagcttttgtttcatcccgagtgaatagcctttagctttgcggttgatataaggtgtcattttgagttgggtgacaatcgcttgcaggttcgcttcatcttgggtatataacgcgagattttgatagcccgttagaaacggataaagtgcgggatgttcgattaacgccccgacagactttaaacctgcatgattggtttcggtcacagattgattatcaatcgtgactgccccggaaaacggaatcagacccagaattgttttcataatggttgttttaccagcaccatttgggccgattaagccgacgatggccccgggttgcacgtcgaatgaaacagcattaataatttggcgatgtctaatccaaatatcgatattcgtcattttaagcatcagtttcctcctaatttttggacaaaaaaagcccctagtaatacacatcaaaaatgattaatgattactaagggcaattcaataaagtttaaaccatggcgcgcttagaattgtgcgttgcaaaatagatgcagccaactacaatgatataagtattcacaacctcactactaacttttaataaatgccgtatgtgagccacttctttctatcgtgcgaattttctcaatctaaatgtgatgcgtcttgtttgcatgaagtgttggcaaatgccagcgatgatgagcggtgcaacaatactggtcaaggtgctaatccagaaagttggctgatcgaaggcaattttaatggctgatatgacattcacttgttcaaaattaacgaagaaataatcggtccaatctggaatcatccgcgtaatgattggtgtgatataacgttcataaatcgtggagataattaaccatgctgcaaataggaaaacccaagctttatgttcaaataaagtaatgaaactactgatcgctaagccctgggccatgaacgtccatacgacgagaattaacgccacgataatgtgggggtctaacaggttagctttaatacccgcgaatgtttggttatgaatcgcgattggatataagattgcaaaggtgaccaattgactgctgaataaactgattaattgtgttaggaagctaatctttctcggaatcccattcaaaatggcaaaattaaaagtttttcgagtggttgtaaaggcctgaacgaccaatgtgatttggctcaggaataagaaacccgtcacaattgtaaggccaaagttgccaaagtcaatgcctttttttatgaagataatggcaacgacaaccatcccgccgaaaaatccgaaggcaccccccgccagtgttttccaaatggcggtcaggcggtaccgcatcattgcattaaacatgtgcttcacttcctttgttcgttaatttaatgaaagtttcttgtagatcgatatggtcaatcgttagacgatctggaataacccgttcttctggtaagacgtcataaagataaaccgtgtataaggtccccatttgctgggaatctaagacgtttaagtcggtacagtactcgcgaacaagttcttccgggccactgacacggtaactcttggcgaggacggtttccaaatcatcattgacaattaattgagcgtcgttcaagaccaagacgtgttcgactaaggtcgcgatttcttcgatgatatgggtcgcaacgacaaatgtccgtggccgactttcataggcctgtaaaatgtagcggtataagaggctgcggtagttagcatctaagcctaagactggttcatcgaggaaaacatattccgccggcacacaaagcgcaacaattgttttaaaaatcgtgcggtacccagttgaaagctgattgagtttcttttttggattcaaatcaaatgcagtcagcatttctttggcgagtgcatgatcaaatgaaccttgcagtaaggcggtatttttaataatggtccgcaatttgtcatctttattaaagagattgatttccgacatcaagtaaatcgtttgtaacggatgatcgcgaccggttaagaccgtatcgccccatttaatctcacctagggatgcagtttgatgattggctagaatacttaataaggtactcttacccaccccattgcggccgagtaagccgtaaattgtattgggtttaagtgttaagttgatgtcgtcgaggacgacctgtttcccaaattgtttaatcagttgtgtggtttgtaaattaggcatggtcataacccctttcaatcagtgcaattaggtcgtctttggttaggtttaattgttgtgcttcagtgataaattgggcaacatagtgttcaaaaaattcagattgccgtttttcagtgatctgtgcgggtgcgcttgatgtgacgaacatgccgagtccccttttcttttcgattaagccgctggtaacgagttgattcatccctttgagtacagtggctggattgatattgaattgtctggaaatttcagttgtcgatgggacttgactaccaggtggaaagaccccagtaaaaataccctcttcaatttgttcggcaatctgccggtagagtggtgcatcattattaaattcaaaaagcatccggaacacctccgtttcgttaattggttagttacttatgtagttaactataatacgtaggctgcgaaatgtaaaccgctcctcaaaaacattttcaactaacgaatagctgagacgctcttttttgaattaaataactattagtcgttcaagttatagcgtaatttcatgtgttctgagcctgaaatcaccatttggccaagtagggctgtttggcgtttaagtgattcgctagctagtttgttattagctgcttccaagaaggctgcaacgtctttttgatcagcgaaggccttgtcggtttcgttttggattacgtgataggcactcattgcttcgagttcgaaggtgttacgcatatcaacgtagaagtcgtaatctgtatcgccaagtaaggcggttgtacaacttaaccagtacatgttgttcaagtcaaaagtacctgtggcattcttgtatgattctggtgtgtcgttgatattcgtgtagaatggcacgacggtgttaaacgtattggcaccataagctaaccattgaataccggcaatttcagcaggcacgttgttgcgcacttgtaaaatatgcacgttgtgattccggttaattccgattggccggaaacgagttttaacatcttcaggggcgctaccgtaaggatcgtattctgtattttcaaagtgagcgctcaagacgaacttgacgtcttcgattgaaatcttgcggttggcatggcagacgaatggtaaatcttgttccattggatcttgtttgatttcaggattgaagtattgttgaccgtaccatgtccgtgggttgttataaaccgtatctttgattgaagcactgccgaaaatatgacggagattgtagccttcaaagtcaggatttaagtggttgtcatcaattaatgtttttaaatcagctgagcaaagcgtgtcggctgaatcaaagtcgaaatgatcgatgttcatccggttaggggcaaccacgtatgcatcatcagggatgcgaacagcagcccagtgatgaccaccgattgtttcaagccaccaaacactgtctttgtcagaaaaggcaatcccgtttggttcgtatgtgccgaattcttcaaggagggcgcctaaacgttcgaccccttcttgagcactgtggatgtaaggcaagactaatgtcacaatatcttcttcaccgatgccaccagggacaaaaggatcaagcccttgaatccgggggttagtggtaatcgtttctgtggcagacatcgtgatgttttcactgttaatcccagcagctggccaaatcccgttcgtcaataatgagttaggaattgaggtatagcgcattgggttatcaggcaattggatttgaacgccgctaatcaccgcttgataatctcggggttggtcttcaggattgaccacaacaaagcgttgtggatccaaagcttcgtggccatcatcatttctagaaatcatggttgaaccgtcgatggaagcttttttgccgactaagaccgtggtacatgaccctttaattggtttttgcatgtcaaaacactccttttatttattatccatagtataacgcttttggcgggaaaagggtggcgagaccggcttgttttcaattattttagttgtagaatgaaagtggaaagttaaaacacggttcggttggtagtccggacgtaacaatgatttgttatcagtaacctgcctccttggttgtccatctttctagtactattaaggaggtttgcagcatgcaaaatgtggtgcaaagtcagttaaccatcgtgtttgaaccaccgttttatcaagcggtatttgagcgttggtatcagaatcagtatgcggttgcccgtgtgaattgcggcactgtggcacctaaatccgcggttattttggacttagtgatgtatcattgggatgcgatccattggtatcaacaactcgatgttgatacggtacaggatagtcggcgtgttaatccgaagcgattacaacggttagcgcgcaaagcggttgtcaacggaacaagtaccaaagcgcaattagcgttgagccgccaacatgaagatcaacacgcaacgaagcggattgcgttgcgtgatgctaagcaacgcaatcaggcagagcggttcgaacagcgccaagctaaacaccgcgaaaaacatcggggacactgaaaaagaagaggtggggtaatccgcatctcttctttttaatatcgtcagacaaaatatgaggtttagttaaataatgatatactcgatttgatttaaaggaaagaggcgactaatgttgaagctggccaattgtttattagtgattgatctccaaaatggtgtctgcaaaagtgagcagcctgttgcgcgtcttaatcaattaattaaaggcgttaatgccagaattgacgcctatcaggcggaaaatcgcccgattatttttatccaacataacgatgagactttgattgctggtcagtcgacttggcagataatgccagaattgaatgtgcctaaaacggcaatctttgttcaaaaaacgcatgcggattcattttggcagacgaacttacaaactttattgagccaaatgcaaatcaaatcgcttgaaatttgtggtgcccagaccgaatactgcgtcgatacaacgattaaagttgcccaccatttgggctaccaactccaaatggtagctggtctttcaactacaacggacaacgcctatatgacggctgaacagacaattgccttttacgaaggaatttggcagggaagattcctaaaattggctaaaatggatgggcaaaacaacagattattttggtgtactactacgaagaattaatttgactggtattaattcaattctttttgtcagttttgtattggtagaagttaattgtttagtaatcaggcggcaagctctttgtgctaaggttccagtatcttgttgaaccgtcgatattgaaggtgttgaaatcaatgagacaggtgcatcatcaaagccaattatgcttagttcatctggaattgaaagaccttgttttattgctgcgcgcgcgaccatgaatgcgatgtaatcattaatggcaaagacgccaattcttcgttcagtaagttgtggcttgatcgaactgataaaagaatcgagttccttattttccagcaggtactgatcagaggtcatgttgagttgaatgacgcgttcttgagcagagtcaatgatgttatagttaaaaagagtatccttgaatcccttaattcgttcaacagtcgcagatgagtttgttttagttgttatgataaaaggagagtagtggcgcttaatcaagaattcagttgctttttgtgcaccagtgtagtggtcagaagtaatgatgaattcatctttcagatgtgggttgcgatcgatataaacaacggggacgcggatgctcaaactttcctcagcatgatcgttggcagaaataataattaagccgtcaaccatgtgttctgataaaactttcaaatagttttgttctcgggagagactacgttcggtattgcatacgatgctcgaaaacccagctgcaaataaattctgttcacattttttaacgacggcagaatagaattcatttgtaatgtctggcacgaggattccgattgtattggatttgtttttgcgaagactaactgctaatttattttgttcataattaagttcggcaatggcgtctagaacacgttgtcgagtttcttcagaaaaacgtccgttgttattgattacacgggaaaccgtagcgactgaaactttacttagtttggcgacatcttttatggagtatttcttagtcatgagatattaaatcctttcgaaataaaatatttaaatgtaagcgttgacatttcatgtgaagtgagcttaaataaagaagaagtagaataacatttgagaaaacgtttacccattgtttatatagtatatcataacgctattattttttagcatttgagaaaacgtttactcaaaaaatatggagggatttaacatgaaaggtttaaatattgaaatttatgctgatggagctgttgtgtcagacatggttgctgctaaaaatcagggaattgtaacaggatttacaacgaatccaactttgatgaaacgcgcagggattacagattacgttgcttttgcgaaagaaacattaagcgaagtggatggggcgccaatctcatttgaagttttcgcagatgattttcaaacaatgaaattagaagcagaaaaaattgctaaattaggtcctaatgtttttgttaaaatcccgatcacgaatacaaaaggtgagtcttcagtgccgctaattaaatcactttcggaagaaaatatttcaataaatgttacagcaattctaacgattgaacaagtaaaagaagttttagaggcttttaaaccagggacagaaaatattgtttcagtatttgcaggtagagttgctgatacaggcgttgatccaaccaaacttatgaaagaatcagtgcggttggttgcagaaaaaggaaatgctaagttactctgggcaagttcgcgagaagtgttgaatatcatacaggctgatcagttaggagtagacattattacggtaacaagtccaatattaaataaattagatatgttgggaatggatgctaaagaattatctttagatactgttattggatttaataaagatattaaagacctcgggttttcgattctataatataaaagggaggtaggagatatgttacttgcggcaatcttagtagcaattttagcaacattctcacaatggtggtttttcgcaccaattacacggtgtatgacttacccgctgacaactgggcttttagttgggatttttatgggacacccaatgctcggaatgttggcaggtgccaatattcaattagtttaccttggttggattaatgctgggggagttatgccaagtaatactatggtagctgggatttatgggacagcactaacaatattatcaagtgctaaccctaaattagctgtgacatttgcaattccatttagtttattaggcttattaatggttcaaatttatcagacattgaattctttctgggttcataaagctgataaagcattggatgaaggcaaaattaatcaagtaagatggttgaattttgtaccgtcattcttcgttgcactgatcgtatacggtgtaccagcattctgccttgtgttatttgggaaaggttgggcaaccgcgttaattaatgcaatccctgaaagcctaacaacggcgcttgaagttgttggtggtttaatgccagcattagggattgcaatgttattgaactacttgggtaagaagagtttgaacgcattcttcttcatcggctttttcttagccgtttacttgaaattagatacaacagcggttgctattttctcagctgcgattgcattcttaatcttcattagtcaaagtagtaaagatgctaaaaaggatgcagaaccagctaaaaagaaggtgcggcgtttaacgctgaacaatcgtgctggtgaaagcgagatcgttgccgcagcggtaaccgcacctaacgcaagtggtgcagctgccattgatgtcaatgactatcaagttcaattaaacaaaaaagatttaattcgaacttggttatggcaacaaacagacgaagcagcgtataactacgaacgtttacaagcgcttggtttgacgaatatgatgatctatcccattaagaagttatatagtcctgaacgacaagctgaagaattaaagaaatacatggttttcttcaatacagaaccgcacatggtgggaccaatcattcacgggattgcgttatcaatggaagaagcacgtgctaacgggcaagaagtatctgcagaagatattaacggagttagaacggggttaatgggtcccgccgctgggatcggtgatacagtacaacagggaattatcttcccaattctagcaagtattggggcaacaatggcattggatggaaattacttaggacctgtgttcttcacagtaatctttgaattattgatctatgtcattgggtatctgatgtttatgtttggttataaaaaaggtaagagctccgttatttcaattttgaagaatggtttaattgataaagtcacaaatgcatttagtattgttgggttgatggttgttggaacgatggcagcaacacgggtaacaattgatacgccgttagtgtggactgttggtaagagtaccatgaaattacaagcaattttgaacacactagcgccaggcctaattcctttagcgattacgttgttgatttggaaattagttgctaaaaagattagcccaacttggattatcttgggaatctttgttattggaattcttttctcatatctaaatgtattcggcgttgttgccgctaaatagggggaatatgaatgattcgaattattttagctagtcatggcccattttgtgaaggcttattgaccagtttacagatgatcgcggggccacaagaaaatatttttgctttacagttgcatgaaggtgaggcgccagatgattatcgagaaaaattgaatcaattgttagccgatgatcaatctggtaaagggacgcttgtattatgtgatttaaaaggagggacaccgcataactcagttgcattcgctagccaaaaacatcatttagcactagttacggggatgaatatgccgatgattattactttggcaacgatgagatctgaaatgtcaacgctatcggagctagttgatattactctacaatcagaaagtattggtgttgaaaaaattgaattagagttcgttagttgaaacgctcttttttgagttgtcctcttttttcagtagcgtataataaatactattactcaaaccacactaaggagtcatttatcttttgaaaccccaaaaattaaaactatcggattacttactcggctttggattcgtattattgatggtcggcattgccactgtcttgaacgatgttgagattattctacccgaaatcgcagccttaacaacggggctgtggatttatcacgaaccgggttggctcaatcaacccgccaagatattttggctgccatcgataaccgccatcgttgggtttggcattaatcggttgccgctcagttatgcagttaaaattagcttactactactcatcatgattgttttactttgtttatttcgctcaacactcgcgccatcgtttgcaacggggctgttaccgattatcgtcaacgccactgaactttcattcatcattgcgattttaagtttcacgctcactttgatgttggtcgttagcctccgcaaattgcatctgcaacatccctatcatgccacgattaactatcgcgtcatgctggtttttctaatcattgcactcttatgggtgttagttgttagtttactcggccggccacagatggctgccattccgccggtacttgtcgtcttttttgaaattctacaaaaaccaatgtatccaggtaaaatggccatcaagcagatggttgcattaactggcgccgccacaatcggattcgtcgcttatagcttacttgattcacggttattggtaaccttaattgcactgccactagtttgggtattactctatctgctacaagtcagaattcccgccgcctacgccttccctttattggccattattctcccacaccaaatgtttcaaagtttgccgctcgtcactttactggcaactagttactttttgggggctgcttatttataccagcaatacattaagccgcgtctcatcagcagataacatgacggtttacgactaatgagggccaaacgtgggcggataatcaacattcgcaaactgctggtcaacgcggtcccgttttaattcaggattatcaattgctcgaaaaactcgcgcattttaatcgtgaacggattccagaacgggtcgtgcatgccaaaggcgccggtgctaaaggttacttccaactcactaaggatatgagcgcctacacaaaggcagccattttcagtggtgctggtaagaaaacaccaatgattgcgcgcttctcacaagtagctggtgaagccggctatcccgatacttatcgtgatgtgcgtggatttgcccttaagttctataccgaagaaggcaactatgacattgttggtaataatacgcccgttttctttgttaatgatcctctgaaattccctgatttcattcactcccaaaaacgagatccacgaacacacgcgagaagccaagacatgcagtgggatttctggtcactttcacctgaatcagtccatcaggtgacgattttaatgagtgatcgcgggattcccgctagttatcggatgatgcatggctacggtagtcatacctttaaatgggtgaatgctgctggtgagcagttctgggtaaaataccacttcaagacaaaccaaggcgtccataacttaagtaacgaactggctgccgaattggctggtaaagatacagattatctacaaaatgatttatttgatgcgattgaaacaggcgactatccaagttggaccgttgccgttcaaattgttccttatgaagctggtttaaactatccgcaagatatctttgatgtgacgaaggtcatttcacaaaaggattaccccttaatcgaaatcggtcaaatggtactcgatgaaaatccaaccaacaactttgaggatatcgaagaattggctttctcacctgctaacttagttcctgggattgaagcttcccctgacaaactcctccagggacggttgttcggttataaagatgctgaacgttaccgtctaggtgccaactatgaacaattacctgttaaccggccaaaagtgcccgtgcataattacgaacgcgacgggatcatggcacaaaaccaagagacaggcgtcaactatgaacctaatagtgaagatggtccaaaagaagtcccatctgccaaaattcatggcgaccaacttagcggtcaaaccggtaactatcctgccgatcccgattactattcagcagccgataagctttacaacttactaactgatgaagaacaagagcgactaatcgaaaacattcgcttaaatctcggccaagttacaaaacctgaaattcaaatccgcgaagtcaaacaattctaccaagcggatccagaatacggtcgccgagtcgcaacggcattaaatttagatttaaaccaatttgaacactaatctatacaaaaagaaggtatccggcccaccggataccttctttttatttatcttcttttggagaatcttgttttgctgcccattctttcttggtcatcaagtcagagacattcattttaatcttcgtcacgtttaaaccagtcatttgatgtactgatttagcgatgcgttcaattatttgttcgaagatgtctggcgctgatttaccgtattccaagatggcatccaattcaatcgttacttcttggttatcaatatcggcatcaacgccctttgtcggatcttcttggtctctgaaacgatcagctaattgactcatcatcccgcctgataattctaagacgccatcgatgtcatgcaccgtttggcccgcaattttttcaatcacaccatccgagaagttcaattctttttcgattttttcggtatgttgatccattggcttatccatcattttatccattggtttgtttggtttatccatcgttttcatcatcctttactatttttattgaacgcgtttttcagaatcgcttttctttggattactgccttgttgttgccattctttcttagtcataatgtcactgacatggctgttaacttcgacaacactcaagccggtcattgattcgacagcttcagtcactgcagctgttaatcgttcgaaaacatcccgtgcattccggccgtattccaaaataatggtcatgtcgattgcgacctgtttttcgccaacttccacactgatgcccttcgttggatcactatcgtttctaaaacgatccgcaatatcactgaagaaattaccgttcatcgataataagccatcaatgttttgcgctgtcttaccagcaattttggcgattacagcatcttcaaaagtcaatttgctattggccatcacttcatctaaatgtgcttgttctaccattttgtcacacctccgttatttatcctgcttcaagacccggttaacttgtgatctaaatccttctagatcttccttagaccctgttaaactagctgcaatgtagccgagtaaaccagcgatgataatcaagattaaactcataaatccaaaactaatccaaatggctgccaacactgccccaacaacaaagccccaataagaacgtctcatttgtctcacctcacatcactttttgcctgattacttagcggtgatagtttgacattcactgctttaatcggcatctcaaagattgtttgtaatgcttgctgtaccgtttctttaactgcccgtgcttgttgatcgagatcgttgcgatccactgcgaccgcttgaacgtcggcaatcacttttggatgtcggcctttaaacgtcgtatggactaacacttccttaacacggtgtttttcaataatagcttgtgtcactgttttttcaaccgctttgcgggaaagtgctagttcacctttatcggtcttgatgatcatttggcgttttttcggtggactgaataatgccaatagcagtaaatataagaaaattaagccgctaagcactcctaatccaagtccaaaattaccgacccattgttcgggtagccaactaagatgcataaattgcttattggattgttgtagtggatagattaatgtgataaaccacgctacctgacacaacccaagcaaactggctaaactgatcaccactttagttaatttattcatggtgtccgcccctttgtattaggattttctacgtgtgaataataatgaaacaacgaaaacgacaatcacggcaccgataatggatgggattaaggccatcccggcaagctgtggtccccagctgccaaacaatgattggcctagccaggcgccgactaacccaccgacgatattgccgatccaacctgcaggtaaatcacgacttgttaatgcccccgcaatcaccccaattaaagcgccaataattaaaacccataaccaatgtaacataacaatcatcctttcttgtttccttaaaatatattgctggttctccataaatgtaacaaattcaaccagcatccgtaaaacaatacgcttatcaatattattaaattatcgtaaatgcacttgtttaattaattgattcgccaccggtaacgccgtaaatttgaccggtaatatagcttgctgcgttgcttgctaaaaaaacatatagcggtgctaattccgccggttggccggctctttctagcaatgtattctgcccaaacttaggcaaagccccttccagttgtccttgagccaactgcaacggtgtccaaatcggacctggtgcaaccccgttgacccgaatacctttatccgctaattgttgcgctagattgatcgtaaaattcttgattgctgcttttgttgctgcataatctaacaaatgcggactcggattaaaggcttgcactgaagtggtcgtcagaatactgccgccagccggtaattgaggcaatgctgcttgcacaagcgcatacatcgcaaccacattaacgttaaaactatcttgaacttgttctattggtaattcggtaattgatggatgcgcaatttgttgagctgcgtttaagactaatgtgtcaagtgtgccaatttgctgctgcgcggtttccactacttggctagcaatctgtggtttccgaaaatcagctgggatcaatgcgattttacgccctgcatctcgcaccaattgagccacttcttgtgcatccacttcttcacctggcaaatattgcaatgcaatgtctgctccttctcgggcaaacgcaattgcaactgcgcgaccgataccagaatctcctccggtaatcagcactttacgatctagtaaccgttgtgcaccacggtagtgttcttcgccacaatctggcttgggatgcatttgatcttgcaatgccggactagcttgttcttgttcttgaaatggctctgtccgataaagtgttcgcggatcttttaaatctggtttacccatcttcttgttccctcttttccaattaatctagatacactgcttttaaatgttcaatatcctgcgttgttaatcctaaggcctgttgtaaataggcttgagttgaaccataatcctcattgattatgcgctcagctgcgtttaagtaggactgatcaacactcatcaatgcatgcatactttttaaaaagccgcttgaggcatctttttgacgtagcgtcttaatgcgggctgcaacgtgttccctagatgctgtattcgataatagataatcatattggatcacatcttcaggtaccccgagtgcatttaataaataataagccgccattccggtacggtctttgccacctgtacagtgaaataaaactgcttgttgcggatcggcttcagtcaataatcgttcgaagaattggcgatacattccgattgaatagggatcttgcaccatttctcgatagacttggcgcatttgttgctgcccaccaagcggattattggtgtagcgctcataaagttccgcttcactcgccgtactttgcgtcgcatcttctttaaaaattggcaacgattcgtaagatgccgtcgtaatctttttatctggcgcttttttgcgctccattggtgaacgaaaatccacgacataggtgatatggtagctttccaagagcaccaattctctcttactaagattcgccagattccccgttctgaataatcgatgcggtttaatcgagcgaccatccagtgtttgatagccacctagttctctgaaattgtagccatttttaattggtaatatgcgcgaaaccatcgactcatcctctctaatcaaccactttggctgctaggatcattgattatcatccaatttttgaagacacctttttaccgtcttgttactaaaaacacgaccatgatgatcaaattccaatggcccccagctctcaccgacgagggcctcaccgttattctctcttaaaattgcttcctccaaatcagtcataccttctagaaaacactttagattggctgattctttcttaatcaccaagcacaattctggggtcttgactgtactacgacctaacctaactttcctaattgggacttcttttgctttcccttttttattctataattgtttgatttatctgccgtaagtgctccaagtccgttgctttgatgccagtatgcttagtaatatctttttttagcgctttgtacttgcggaggccttcttcagttgcttctaaccaaacattccgttggtcattttccatatcacgaattttgcgaataaactttttactttgtagcgtattgattttacgggaagccgctggtgcggaggtcccaaatacgactgcaatttggcctggggtgttccgtcctagttccacaatctgttccaacacgagaaattgatcataacttaagccatgtttttcgctcattttattcaattgagtcgtgatgttctgacactccagataccactcactaattgttaatattcttttattatctggcatctgcaaccctccaccgttcattcaatatagttttaacttatgtacaataaatgaccaccggctagtcaaaagtcgacaatcatttatttaaaacaaactagcgactcatttcaacttgattaagcagcagttaaggttagtttatatcgttgtttggttatgtgcaagtatatttcacgcgacgataattgtcaatcgttcattaaaaaccttttaaaaccaatgtttgagcgatgtttttcggattattttaatttgtagataaacttacgaattttctgaaaacgccaataagaacctttgatgcgaaggggtcacaactcatgagttatgacctagtttatttttataaaaatcaacaattaatgccgataattcatttgcgcaactattttatttttcgtctatccgttgctacaattggtttttggccacaaaaaaaacgaagttcagttaattcacgaacttcgttttttgtgttaaacgactggatatttattttttaaatagtaataaaagggcaatccgagtaatgtaattccgattccgattaaagttaacatcgtctgggtgaataacgtattcaccacgatgaaaatcccaccaagaatggcgatgactggaaccactggataaccaagtgtgcggtatggccgcggtaagtcaggttcacgtttgcgcagaatgaacacagcgataaacgttagaatatagaaaatccagatgacaacgaccaacatatcagtcaatgtattgaagccacccatgaacatcataacgatggcgatactaatttgaactaaaccactgacaaccggcgtgcctgttttagaaagggagcgcagttgtcgactgaatggtaaccgattctcgagcgccatcgcataaggaatccgcatcccagtcatcgtgtagccgttaatcccgccatagacggaaattaaaatcccaatagtgatgattttaccacccacaccaccaaatagcactcgagccacttctgaagccgcattcggattgccggcaatctgattgattggcaacacaagaacgaagacggcgctcactaagaggtagacaaccatggttcctgttaaaccaattaaaattgaccgcggcaaatcgcgttctggatgcttcaattcacccgcaatattcccaacgtgaatccagccatcatacgcaaagagggttgctaaaacaccactccccagcgctgacaggaaactccccgatccatttgaccgggtcacgtcaaataatgacacatgaacggcgttgctgcctggatgaattaacccgaatacaataataatcgcaagcgggattaatttaaagacggttgtgaaggattggaatagtcccccaacccgggaaccaaagaaattcaagattgttaagctgagtccgacgatgattgcaattggaatctgccagtgagctgaccaactgaataagttaatgcattgcgttgcaaaaacaatcgacaacgccgcaatgttcgctggaaagtagactgttgtttcggcccaacctaataaaaatgccgctaaactaccataagtatggtcgatgtaccgcatcatcccgccagtttctggaatcgcagctgctaattcagcagctgtcaatccggcacaaattgtgattaagccgccgacaagccatgcaagcattgtcagcccggtggagccggtcgcatgcgtcacaggatccgctttaaagaacacaccagcaccgatgaccgttcccatcacagtggctaatgccgcggtaaatccaatcgtttgatttaatgcttgtttttccgtgggcatcttaaccgcctcctaatatcatttataatatttattatgacatgttgaaagcggtctttactagtctaatttgcaactaaattcggatatgtgcggcggaaatcttccattgcaccaatcaagttcgcatcattatgatactgacacgtccgaatggttggcatgaaaggcgcaatatcgacttgcttcagtattttctgtaatgctttttcaatatttggcaccaagaaatcggcctgcgataccccaccacctaaaataatcgcttctggatcaaagctatattgtaaattatagatggcttgtgcgagattatcatagagcacctgtgcctctttttgcgcgagtaaatcgccttgatcagccaattcaaaaacttcacgccctgagtagttagtatgtgcctcttgattataacggtcagccatgtgaacggcggtcccgacttcacttaaaatccgaccatcattcatcatcatgtagccaaactcaccaccgaataaatggcgaccatgttggacttgtccgttgacaatcactgaaccaccaacgccagtgccaattaccatgaacaacacattttttagccctttagcagccccactaccgacttcggctaaagccgcgcaattcgcatcattttccattacgactggtaagtcaaagcgcgtttcaagttcatcttgaatttcaaaatgatgaatataagggagcgcactggccccttcaataatacccgtcgccttgttcactgcacccggcgtactcattgcgaccccaacaacttggtcactagccttaaactccgccacaatctgcgtcagcacatcataatacgcattcaacgactttggtgtggcaacagccccttgtttggtcaattgttgcgccgcaccatcccataaaccatatttaatcgtagtcccaccaacatcaagtaatgctaaatttttcattcgtcaatcccccaagcgattctcttatgtattctgataaccgcttacattctaccataaaattacgctgggcacccacaacagtgttaattattggcgtacacgctaaaggcgaactttggtttttaatggctttcatggtacacttaacggataaggtgggtaaccacccatttcacatcaaaggagcgtcaacaacatgtcaactaacgtttgtttaatcgcaatcacaattgaataagcatgtggccattttgcggctatttctgttggcattcgctttttaaatttaattaactgagggctgtgacaaaagaatatttttgccatggccctttttttcaattgaaacgtgtgctaaaggccacatgcttattaaaacgtgctccaccaggcatctgctctcggttagctacgtcagccaaataaccaacaaatcggtttttcgtctgcctatgctaatcctcagcagataaccgccggtgccgcactcttatcttaaacgtgctttcttcaaatagccgtctgcgtttagcgccatctcgtaaacaatcggcgttgccgctcatttacgagatattgctaatcctcaacggctgaccatttgaagacgcactctcacaaaaaggagatctcatggaagaaacttatatgcaacctaaaaaggttttaatcactggtgttagtcaacgccaagttaattttgactatacaatgcgcgaactgggcgaactagcccgtgccgataacttagaagtcgttggtgacgttcgccaaaatatcgaccaagctaatcacgccacttattttggtaaagggaaggttcaagaaattaaagaacgcgccgtcgctgaagatgcggacattatcttgattaacgatgaactttcaccttcacagattcggaatttagaaaaagaactcggaataagcattcttgatcggacgcaattaattcttgaaatctttgctagccgtgccaaaacaaaagaagcgcaactccaagtggccatcgccgaagcgaaataccaattaccacgcctccatccttctgaaaacaagttggatcaacaaggtggcgggggtactgcgaaccgtggggcgggtgaaacccaacttgaattggatcgccgactcatcgaaaaacggattacgaagctcaaagccgaacttgctaaaatcgatcaacaacaactcgtacaacgccgtcaacggacgaaaaatgcgattccagttgtcgcactcgtcgggtacaccaatgcaggtaaatcaacgactatgaatcgaattttacaacggttgaaccccgatacacctgaaaaacaagtttttgaaaaggatatgctctttgccaccttagacacgagtgtccgcgaaatcgtcctccccaaccaacagaaattcctgttgagtgatacggttggtttcgtcacaaaacttcctcatcacttaattcaagcctttaaatcaaccttagctgaagcagcgagtgctgatcttttaatccacgtggttgattactcagatccaaactacttggacatgatacaaacgacacaagaaacccttgaatcactcaacattaaagatatcccagtcatcgaggcttacaacaaagctgatttgaagccagatacgcgctatcctgaagtagacggaaaccaaatcgtttattcagctcgcgacgaagtagcaatcgatgcattgattgccttaattaacaaacaactctttgaacaatacccaacgctcgacttcctagtcccatacacagaagggcaagctgtttcgtacctcagtgatcgtgccaatatcactaaacaaagctatgaagaagatggcacgttgattcgtgcacaaatcaacccagacctattaggacccgttaaaaagttccttcaagcatagccaagcgctactttgcggcaaccaaaaaagcccatcgacataaatgtcgatgggctttttttatttcttattgatactttctgaaaaccttatctgcagcttttaaacgggcgatgtcattttctgaaaccccgattgaatgaagggtttccaaatctgcgcgttgatcatctgctagttgcctaattcgttgtaatagcgcggcttcatcaagattaaacccaactttttcgcaaatcatatctagcgtttcaaaatattgcatgctagcaacactagcgtgcaatgtattgataatttcatcgactgttttttctggttttaaataataaatcgtcattttattgtacccactatttttattaggattaaaacacttacttgattgccttaattctataacatttgtggatgaataaaatgcgtatattttaaatagtttaaaaatccggcgaaagataaattaaaaattttatatttatcatcttattaccaagtccagttgctgcgcgtgctggcagatcttcgggtggctctggtggttcgggtggtagcggtggtgggtcttcaccgacatccagttatgttggcggccgtagtcgtgattattattacgatgatgcgggatgtcggcattactacaagtccccaatgcgtcgtttattcgatagtatagtcaccctgcctttcgtattcgtctcccttgggatcatgatttggcgtaaagtgcgtgactggttaaccggacgtagaaaacgggcactggctgataccatgccgttagatgctgaaaccgcggcgcgctttgaaaatgcattctatcaaattgaaacagcttggccctcaaatgacttaagcaacgtggcggacttaatgacgccccattctcagcaccaacaacaacgcatcttaaaccgttatcaacggcaccataaacataaccaacttgagagtatcgccattgtttcaactgagttattattacctgaaaaaccgaaccgccaagatattctagtgacagcgcaaatgcgcgattacttcactgatgagcggcagacagccacggttaatgaccaacgtcgtgaagcggcttatattgaacgtttcagcgaaatttgaacgtttaaattaattgatggtcaatatcgtgtcgctcatattaatcaatccctataaaagagctaccagttggtggttcttttttgttatttaattggttaagtttattgcgttaaacaactttttctcttaaaatagaccttatcgatttaaaaattgtttatccattttgattagaaagtgaggtcatttgatgaccctccatgttggcactggccagacacaaacggccgtttccttaatgccgcgtaacctagacgattgtgtgcgtgaaatagcactcgttgagcaaaagcaagctgcgattgatattctagaatggcgcttagactattggcaaacaccagcgaccttattaacggctggtcaccaaattgccgcctgcaagcaccccgttattttaacgctcagaacaacccatgatggcggcctgtctgatccaaccgactatttagaccgctatacagctctattatcggctcaaatcggcgatgtggttgatattgagtggtctttacctgaggcagttagaaaagccgtcagcgcgcttgcacgtgcgaatggctatcaagtgttactaagccatcacgatttaaagacaacccctgataatctaacacttcaaaaacaactcgcagcaatgcatgcgacgcacccagatatgttaaaactagcaactaccgctcaaagtaatgaggatactactcggttaatggcgattacccagtcttttacacatgatcacacaaccccactaatcacgatggcgatgtctgaatttggcttagcctctcgcatttttggtggtcaattcggttcagctgtgagtttcggttaccttgaacaccccagtgcaccaggccaattactcattgaacaactcaaaggcttgttgacaatgcatcaaaattaaccgcacaaaaaaagccccgcacaaattcaatttgtgcggggctttttagattgttgattagttccgttcaacgtttaaatcattcatcttaagcattgtatcaacggccttttccattgtttcgattgaaacaaattcgtagcgaccgtgcatgttttcagcaccagcaaagatgttaggggttggaatacccatgaatgaaatcttagaaccatctgtcccaccacgaacaggttcgattaatggtttgatatcaacggcttccattgcatctttagcaagatcaacaacgtccatgtgatcttttaagacttctgccatgttgtagtattgatctttgattgttgcaacaacgcggccttcaccgtatttagcattcatttgatcagcaactttagcagcaaatgctttgcgttcttccaaaccatcacgttcgaaatcacgaatgatgtaagccatgtgtgcttcatcaactgtgccttcaaggcttaataagtgatagaaaccttgacgaccgtctgttttttcagggacttcatcgcttggtaaagcattttgtaaatcaacagccacttgaagggcattgatcatgatgtctttagcttcactaggatgcacgtttttaccttgaatatcgactttcatggcagcagcgttgaatgtttcgtattcaagttgaccgattggaccgccatccattgtgtaagcaaagtcggttgcgaaatctttggcatcaaagtgatcagcgccagttccgatttcttcatcggggccaaaaccaatcttgatgtcgccatgtttgatttcaggatgttggactaagaagtccatggctgtcatgatttcagcaaccccagacttatcatctgaacctaataatgttgagccgtcagttgtgattaaagtttggcctttataatttttcatatttgggaattctttaggatctaatacgaatttacccgcatcatctaatttaataattgattcgccatcatagttttcgacgatttgtggattgacacctttggcattgaagtcggcagtatcaacgtgtgataaaaagcccattgttggcacttttttatcaatattacttggtaatagcgctgttacatagccattactttcgttgtatttcacatcacttaatccgatttccttcaagtcgtccatcaatttgtgtaaaaataccacttgtgtttgggttgatgggctcgttgttgcgttttcatctgaacgtgtttcagttgtgacatattctagaaaacgaggaatcaatttttcatatttagccatggtgtagcctcctagatattatttaatactaattctattctaacctacttcgcattaaaaataaatgtaaacggatcagttttttgctgtgatttaatgaatgtaaccgaccaaccacgctgtttggcccacttttcaaaaattcctgtcatcttatccttcacaatactttcgacatgatgaccaggatcaattactgacaaaccagctgccaacatatcgtgaccagtatgataatacacatcaccggtaatgtagacatccgcaccagcttgtaaagcggctgggaagaatttacccccatcgccaccgacaacggcgactgtctgaactattttgtccggttcatttgaaattaagcgcagacctgttaaatcaaatgtttcgcagacaaattgcgcataatcccggaccgtcattgattgagcgacttgaccaatgcgcccaataccaatcggttgttgttgattagctaatggaatcacatcataaacgggttcttcataaggatgcgccgcaagcatcgcctgaacaactttggtttgcatggccactggcagaacaacttcgattttaacttcggtaaccgcttctagatcacctgattggccgatataaggatttgctgcgtccgttggttgaaaacgccctattccggtcgtactaaaactgcaggcttgataatcgccaatatgtcccgcatcagcttgattcaatgccatccgcatctgttcagcatgtgactcagggacaaagaccaccaattttactaatgattggtagtccgtgatgttaaacggctgcacatcgtttagttgtaaagcttcagctagccaatcattcatgccgccgttagtcttatccaaattcgtatgggcggcatataccgtgatgtcatgcgttaacagatccgcatacatcttgttttgcggatcacttagatcgagattccgcgctgggcgaaacattactggatggtgggcaaaaataaaatcaacattctgttcaatcgcttcttgaacggtttctgggcggacatcaagggttactaacacccgttcaatgcttttatcgcgtcgcccgatttgaaaaccggtggggtcattgccttcttttaatgccaatggtgcgtagtcttcaatcgcagcaattaagtcactcgcgactaattttcccatgtcttcatctcctcgattaatgcaatttcatgttcaactgctttgactttatcagtaggtacgacttgtgcgttttgtaattgttgcaataaatgacgccgttttttcaacattgtcccccacttcaattggaaatcagcaggttgtgtttggcggagaacagggccaaacactcgatcactttcgcttaatggtgcaactgatggttggggttcgccgacaatcacttcgtagatatgcccgtcttcagcgacaatcgcttcatcaacgattgcatagtcatgtgcattcaaccattcacggacagtactttccatgatattgggttgtaacacgagtcgttcatggccgttcagatgatccaatccacgggttaaaatttccgtgatcaataaaccacccatgccggcaatcacgatgcaactcacatggtcttcttcaggattcaatacctctacgccatcgcctaagcggacttgaatctgttgttgtaagtgccattgattaacgtgagtctgtgttgattcaaacggaccggcaactacttcaccggcaatggcgcccttcaaccggttttgttccgtaagccaaattggtaaatatgcatgatctgaaccgatatcagcaacaatgctatcttgtgggacaaactgcgcaaccgcagctaaacgctttgataaatgaattggtgacaaaaataaaactccattctagaaactttgattgttatagttagtataccaaattttagacggcatacgcagtcaaagtgaacacttgattctggatagcagaagttgctttaggcaaaatttagttttatactgaaattaaatcgaaaacgctttctatacattaaggagtggtctcatgagttggttgcaactattctgtgttttcatgattggtttaggcatttttcaaatttataagtcgtatcagtattatcaagacttaaaattacacgcagatcaaaatacttctgtctttgcgccagcagcgctctgttcgagtgctttcatggggcttgtctttattgggattagtcttgctagtttattgaattggttataaactgtaaaaaaagagatgtgcgttgagcgtgctatatgaacgcttggccccctaatatatagggggttggttaataacctgataaaacctaggttctaagtaaaggagtggttagcaccaatgattaattttactcccaaattgcaagaacaaattagccacacggtaaatcctattaaatcagtattttcattaatattcatattttatggacttaacttaaccggcggaagcagcggagaaaagctctttgggtgtttgatagccagtttgccggcgctttgtatctcgacgcgaggcacgcttagcaatcgctcgattagaatctgggatggaaaatatttttcagcctactgatcatcctacttttgaagctgtgtacctaaaatggtttgaactatataaaaatacggtcaaagagtcgagctggtcgaacactgaaaagttatttcggttgcacattttgcctaaaattggcgcttataaaattgagcttcttacgcctactattctgcaagatacggttaacgattggtttaatggtaattacaagcgctacaatattccattcgtttatactcgaaaagtattcaactatgcttaccgattagatttaatcgaaaccaacccgattgataaagtgatcgtacccaagaaaacgaatgagctgcgtaaatcaattactaattattttaatcgtgaagagttactcatcttttttgaagcattagaccagtgtagtaatcccgttgaagcaaacctattcaaagttttggcaatgactggcatgcgaaccggcgaggatcgagctcttctgtgggatgatattaatcttgatgatagctcgatttcaatcaataagactgcagcctctggtgcagatggtcgtgttattattcaatcaccaaaaacggcacacggtgaacgtgtgattgagcttgataaaacgaccactctcattttaaagaaatggaaagtgcaacaacgcgagtggttattctttaacgggcaacaccccaaaaagaaacagctagttttcaccaatacctgcaatgaatatattaaccgagcaatgccaactaagtggatggtctcaatgattaattcaattcgcatcactcatcccgatttcaagaagattactgtgcatggtctacgccacacttatgcgacgcttgcttttgagggtggcgcagaaattaaagaggtacaagagcagctcgggcacagcaattatcaaaccacaatggacatctacacagctgttactaagggcaataaaaaagccacttcagagaagctggctaactttatttttggctaaacgtaagcaaaacgtaatcaaaaactagatttcactaactgaacattgttatacaggcgtttatgtatgtatttttcacagggttgaactactcattgatttgatactcttctaaaactacttatcaccttcatcatggttaataaatagaaataaggcgctaaatattaataacatgatacacgtcaaccaaatcttaataagaaccaaatcaacgtccccctataatgtagatataaaaatacaaaatactaaaatagttaatagtcctagtgcaataataatcttataaaatatgtccatgcatttaattggtttatttaatagaattgcacaagccgcaaaaatgaatgtaaatagtgtaaatcctagccaaatgttaactgtccataataataataatcccataattgaaaatctccttatttttctttgtagtctttcaacatatatttagcgtttttaaaactatcactagttaaacaatattgaaataacataaattcattatagtattgctagtacagtagaaattgtgttgaactactcattgatttgatactcttctaaaacagagaatttctcatataaatgtgagctctagttgaactactcattgatttgatactcttctaaaactaatcatgaaggggcaagtgttattgaaggactaggtgttagagaagttggctatattgtttggagtcgtgattcagaaaaaattaattgggcagtaagttatctgccacgattccatgattccacgcaatcctataaaaatgataagcaactttggagattaatactcggaatttataaagggtggtcttaatatgaagattaatattacagaaaacaaagaaaaaacaacgaaaacgcttaatgaatggggtaattttaaggggaactacgatggagaagccaccttaatgaccctgtataatagggggttaagggcatggattcaagacaacggtaatttttcagtattaaattgtaatgcacccatcctagagtttgataaacattcaggtgaaattttagtttacaacagtaaaggtttttatgatgatggagatattcctagttatcacggagatatgtacgatgattacaatgatttattgcctaatattcgcaattggcaagaagctagactcggtattgatttttggacgacagctaattttgataatgttgatatttccattaactattaataattcccaaattgcaagaacaaattagccacacggtaaatcctattaaatcagtattttcattaatattcatattttatggacttaacttaaccggcggaagcagcggagaaaagctctttgggtgtttgatagccagtttgccggcgcggtaaattgtttagctttgactcaactgcttggatatcatggggacccaaaatatccatggatagacccttgggtacatcgcggcggatcattcgattatgcgcttcgttagtcccacgctcagaggaacgatatggatgggcataataaaggtcagcgacaccggtaagtacagcgccaacttccgagaactcagcgccattatcggcagtaactgacttcatgattgatccgtattcttgacagatcttggccagctcatagttgactgaatcagcttacatccagaatgtgtttatccagtgccggtctttgaagattatgaaactgccgctgccgtcctttttgaatatgtgcatgctttctacaataggaagagaattcatagttcactgggctaccagacccccttacaagttgaaattgcaacacttacgagccaaatggccgcctgatttaatgctttccagggttcaaataagttattaatcgcaattaatgatttatttgagctgtggaaggtaaacgcggttctgaatgtctcttaaaatctgtctcaaatattgacttcaatccaaagacgttagattagtctcggaaaacgatgcgtataatgatatgatatatccgagtgaagaaataagaattataggtaaaatcctataaggttatcgagtccagacaagctggcttacgagtgcaagtctcgttactcgaattgtgctgaggcacatatattaaacatccttggagggatatcatgaaaaagattttaggtatagctatagttagtttatgcgcagtttctcttgctgcgtgcggttcaaaaggtgctgaaaatgaagcagcgacgtcatctagctcaaaagttgaaaaggcagtcgataagaccagcgatgtgtcgtcttctgatgatgacgactatgattatgacgacactacggataatagctcggatgacactacggataataactcggatgatactactgctagttcatccgacgaatcagtccctactgaatacacatctgcattgactacggccaaagaatattcagatcagcaacacatgtcgaaagctgggctttatgaacaattaacatctgacgctggcgaaaaattctcagcggaagctggtcaatatgcgattgacaatttaaaagctgactataatgcaaatgctcttgctactgccaaagactatcaagaacaacaaaacatgtcccctgaatctatcagagatcagctaacatctgatgccggcgaaaagtttacacctgatgaagccaattatgcaatccaacacttaaatgactaacaattaacgttcaaccatcggaaaagccgacagcaagtgcaggccttgctggttgatttgcgtttacgcaaaaaaacattttggaggttttacaatggcaaagaaaattaaggacgaaagtggcaatacatacgtccaaaagaaaccggtatacaagcgtgtgtggttttggattttggtggtactagttttaatcgttggcggttctgctttagggggcaacaaagacaacggcggtaagaaagtgagctcaacaagtacaagcagcaaaaaggaatcttcaagtaaattatacaaactaggcgacaccgttaaggttggggacgtaacttacacattgaactctgtcgaaaaaactgacgaacgtaatcagtttgatgacacaaaaccagctaatgttattaaggttacctatcacgttaagaacaacggtaaagaagatttacctgtcggcactgatttaaacgtatacggaccagctaacaataagttaaaaacatatgctcttgaaaacacaatggatgcagttgctgctggtaaagaaatggacgtaacagctgcttacggcaccgataagatgggtaaatttgaattacaatttgcaccactagtttcgattaagcaagctgctaagtatcaagtagaagttaactagtttcgttcgatcaccagacaagctggctgtgagtgcaaggctcgttactcgaatttcattaaaaaagcctcaatgaatcgtggggattcactaaggctagtttatgcaatattcaaacatattttatcatatttggaggattgaaatgaaacaaatttggaaatttttcatcggacttgtagtcgcaattatcgtgattagtttagctatgaccgttggagcggccattcttttgggagtgtcaatttattttggggttaagtattatcaaaaatacaaaggagtttaatgatgttaaaaatcggtgttattggactaggaaacattgcacaaaaagcatatttacctgtaatggcgcagatgcaagaccgggtcgattgggtcttatgtacgcgccaaccggctaaattagcgcagcttcaagcgcaatatcatttagaaagtggctgcctatcatttgacacattactcgaacaaccactcgacgcagttttcattcacaccccaactgcaacccactatcaatatgttaaacaagccctgttccatggtttacacgtttttgtcgataaacccttaagtgaaaatccactggaagtcgccgaattatacaaactcgcggctagcaaagaacggctcttaacggtcggcttcaaccgccgttttgccccatttttgcaaaaattaaatcacttacccgataaacaactgattaacatcactaaaacacgcgtggcaacgagccaaccaacgccctttgccatttatgacctgatgattcataccattgatacggcgcttttcttggctgattcactaggtaccaattacaaaatccgtccatactgtcagcaggatgcaaacggcaatttacaactcgcgcaattaaccattgaaacaccgcgccaattaatcagcgcgactttaaatatgcaaagtggtaccaatcaagaaattgcaagtctccagacaccacacgggttattcactgtcgataatctaacgcgctacacaacacaagcggcagaagacagtcgcattcaaactgcagctgactggacgcctacgcttgaaacgcggggctttgcgccaatgattgatgcgtttattactgcccttgaaactaacggcgcaaatcctgtcccactagaaagtagcttactcacccaccaactctgtcatgagatggtccactttacaaaataatataaaaaagcgtaacccaatacagtatttgtatcaggttacgctttttacatgcttgagcgcactctatttttggctttctaaatccttggcaattgttgcgtcgatgcctttaaccactgctgtcattaagccggcttcttccattgctaacaagccagcaacggttgtgccacctggtgatgaaacttgatccactaagtcccaaggtgaatcatcactcataagcacgttttgggcactccctaaaacagcttgggctgcaatttcagttgcggctttctttgttaaaccgtgtttaacgccggcccgcgccattgaatcaatgaataggtaaacaaatgctggtgaactaccggcaagcgcactgaaagttgtgaaatctttttcgccgatttcaaccacgccccccagttgtgcaaggacatccttcacccgacccaattgctctgcattgacttgttcgttaccaacaacagctgttatccctgcgcgattggccacgttaacatttggcatgatgcgtagaattggtaaatctgcagcagattgttctgctaatttatcaagtgataaacctgctgccattgaaaccatcaatggttgatgtgctttaaaggctgcatttgtttctactaaaacctgtggcacaatatatggttttaccgctaaaaaaacgatgtcggcttgttcaaccactgaattgttatccgcaacagctgtaatccgttgttcagccacaaaattcgcatagttcgccggatgtccgccatgcactaaaatatccgttgttgcgacttgattagctttcactaagcctttaatcattgcttgtgccatattcccgacaccaataaatccaattttcattctgccacccctttttttatttatccaaggataccgaacgagcggaggaaagtcaatccaggacacaaaaaaagacatcttagcaagatgtctttaaagtattgggctagctggattcgaaccagcgcatgacaggatcaaaacctgttgccttaccgcttggccatagcccaatcaagtggaggagagtggattcgaaccaccgaacccgaaggagcggatttacagtccgccgcgtttagccacttcgctactcctccatacatttcatctcatcgattcaactatattagtttacaaaattctgacagaaaaatcaaccccaaaatgcaaaaaaaatcttgattattgcataaataatcaagattttttctaatatttagttaacgccttccattaacttatgaactggtttaacgaagaagattaagacgatcccgaagatcgcactcacaatcccaatccctaagaaatatctaatttctgtttgtggtgaatataaacgcacaagctgtgcattaattgcttggcccgcagcatctgctaagaaccacatactcatcatttgtgattggaatgcctttggcgctaattttgttgtaattgacaacccaattggtgaaattaacatttcagcaatttcaacgatgaaccatgaaccgattaaccagaatgggctaactcggccagcggtgccgtgtaataatccaggaagtgccataaacatgtatgacaaaccagcgaagattaaaccaacagcaaatttaccaggtgcagatggttgtttcttccaagcactccataaccatacaaagaatggcgttagaagcataataaatagtggattcaatgattggaaatttgatgcagctaagctatgcccaccaatgtttagaattgtccgatcttctgcaaataaagctagaacaacggagccagattcttcaattccccagaagatagcagctgcaataaagagtggaatataagctataacgcgtgaacgttccttcttagtcactttcttgctgcccaacatccgtgagaagtacacaattggtaatgcaatcgcaatgattgaaatcatcaagacgatgttatcaatgtttaagttgcctgtaaattgcatgcctaatactacggcaacgacgaccacgacaccaatcacaattttacgaataacgcttgataattcttctggcgcaattggatcattaggttttgaattttctttactgaattgagaacgaccgcggtagtattggattaaaccaaagaacatcccgacagcggctaatgagaagcctaagtgaaaatcaattttttgaccgacagccccaacaagaattggagcgataaatgagcccaagttaatcccgaagacgaacatactgaaaccagcatcacggcgacgatcattttcactatacaaactaccaaccatttcagaaacgttaggttttaataacccagtccctgcaacaatcaaagcaattgaaataaataaagctgtcgcacccatcggcattgctaaggcaatatggcctaacataatcaagacaccaccgatgaagacggttttgaagctcccccagatccgatcacttaaccaaccaccaacaatgctggctaggtaaaccatcgaaccatagattgccatcacagacattgcagtcgtcttgtcaaagccaagaccacccttatctaaagcaaaatacatatagaataatagaattgcacgcatcccgtagtagctaaaccgttcccacatttcagtgaagaacagtgttgatagcccatgcggttgcccaaagaatgttttttcttgtttctcttccattgtaataccccactttaaaactttattattacggaaactaagaatttgatagttattaaattgaatcgactcatctatacaagaagtctcttatcattcgcttagaatctataagggctattataatcttattttaatcttaaatcaattcttttttcaacattaactgcattgtttgcactgattttttcattaaaataagttattttatgattcaaaatgactaatgcttattcttaaatgagaaaatgctcatgatacctaacatgttcttagaaaactggtttgttgcctttaaacagtagtacaatgaactaatagaaagcgagctgattccgatgaacccttttacactaacatctcttattccattacgacctgatcgttggctaacttactacgaagcaatgtatcaaaatgaacacggcgatttaatgccttatcattttgtcagtcgtgactctaacttaaccatcgagactttaaaacgaccagctaatgcctcagcggttgcaatgttctgctacaatcaaaatcactcacaggtcttactgactaaacaatttagacagccccttaatgattttgtctatgtaatcccgccggtttagttgaaccaactgagtcgattaaacaagccatttcccgtgagttaatggcggaaacaggttactctcttattgaggttgaacattgctttgcgccaagttattcctcaccaggccttactgatggcgccgttagtctagcaatctgtactcttgatcaagctaaacaaacagaccgtacacttgaagtggatgaagccttaagtaccctgtgggttaatcgtgctgaagcacagacgatcttagccaatgaaaaaatgactggacgcactcagattctattatggcaatgggcaaatgaacaataagtaatagccagttacgattttcgtaactggctattttagtggttgttttacaatcaaattgaatattaaaaaagcattatactaacaaaacgtcagtacaatgctgattatcacgattagcacttggtagaaacatgctattgatgccggctgcaggagtcgaacctgtgaccctcggtttacgataccgatgctctaccaactgagctaagccggcattattgatgacccgtacgggatttgaacccatgataccgccgtgaaagggcggtgtcttaaccacttgaccaacgggccgaaataaaaaacgattgaagattctcaaccgttcaatgatttgatactcttctaaaacacacaactaaaggtatgagaaagattaccagttgaactactcattgatttgatactcttctaaaactgttcattatgcttcctccgtttcattttcgttgaactactcattgatttgatactcttctaaaaccgtcgttttttcatcagaatttcattttattcatagcgccattcgacataatcattatcgatgtgataataacaacatttctggtactgatcagatttaacctcttctgaaaattcaatgagaaagagtttcacattcaatgtcgccaccaacctcaccaattcattaaattggttgatactgagatagtgcgaaacgttgatcaacgtgattatttttgattcatttaactctactgctgtctgtactatactctcaattataccatatgggtcatgctggacggcagtcgaaaattgtaaattatagaacttaatcattctttgaagatcccattcctggttgacatctaaggtcaattcatacataaaggccgcatccaaaatcgttgaacgaatctcactatctaactgagttaatttctggcgctgctgatccgttaagtcggcggcgcattttttaatcaaccgattttgaaatagatgattcaaattaattgctgccacatccccaccccaaataacagcctttgaataatccattaattcgtattgatcattgctaaatttaacggtctcttgtgcgccggacattccagcaatgagtttggtatacacttctggactgcttgtactgcaaaccgttattttcttattctgaacgctaaagggttggtatggataaaaagtaatgttcataaaattaacgtcctctcagcagaattacggacgtcatcactcgattcgcccactaagaaatgcattttattatattgttgctcagtaaccatcaacgtttgtactaagcctgctggcggagtaaagccagcaattcggttctcgataaactgcgccgattgtttgctgacacaaactcgaacataaacagaatattgaatcattaaaaaaccttcgttaagcagcgcttttctaaaatgacggtacgccttgcgatcctcgctcgtttcaactggtaaatcaaacatgactaataagcgcattattcggtacctcatgagtcattaccacctttacgtcaaactcttctttcggagttgtcatgaatttcaaacaattctgtacgtgtttagtgagtgcatttctaaggattgtgatctgtccattatattctagctcaagattcagtaactccaccaaaccaaatttaacatcaggggttaattcattaaacttttgatgtgccacccaataatcaatcactggtcgaaaaggttccattagatcggaacccaaattaaaatcactgacgccattgtgatgatgaatgccaaactgtgttaaatagccattacaaacaatttcgcgattaacggctgataacaacaaactataaccataattaagggctgcattaatgggactgtactccgttcgaacaaagtctttatcaaaaactaactgaaaatacttgcgcgcaatcacggcttctcgatttgttcgatcagcaaataccattgcatcagcttctgttgttaagtcttcaatatcctttcctaacaattgtgcacattgaatttgcatcgctattttggcttgaataatcgccgtccataaggtttctttcaaccccgttccccattcaacctgttgctggatcgacgcgagactacgatttcctggataatccgcaattgtctcgcaagttggattaccatctttacctgtaaaaataatcttagcgccagcttcactcaactcagtaattgccgatgccgttaaaacggcctgggtagtcgcaactaacaaaatttggatatcatcaattggtacttggtgtgttgcatcttttgtctggacaacaatcttccgtccagaataagaaacctttgcatgttgtgaaatcacaactgttcgccaactcataaaaatttaccccctacatccttgttttcaaaatgatgacatgctataatgctgttgttgagcttgatacactcaatcgaaatactcattgatttgatactctgagttaaaatcaaacaaggtcttcggaccaagttttctattctgagcctcttatgaggcctttttttatgccttcaaaccaaaaagctagcccatcattacactaatgacaggctagctttatttgtttataaatcccttaaagctactcgtcgttcgaataaaccggttggagattgatagataatttgggtgtcagacgacagcgtaattcctgtaggttgctgtatcattccaaatggcgtggtcattttcaatactttaagatcactcatcgcagcatttgcatgcaatccaattagaactctatccaatataatttgttgcccaacctgcaccatcttattaccatcccattgactcttccacggcaacttcataaaggctgctttacccgcagataatttagctctgaattgattagtatcatatagtgggaaatagtgcatcacttgatctaagatttcatcataaacttgttcagcgagttcttcagactgtgttaaaggtagcgcgccatttaataatttaacagccgttttatcgagaatcagttcctgctcgttgtgtttatacgtcgcagagcccaatgtcaattcttgaccattatcgaagaaacgttggttgattaggatatgtggtgcaatgacttcaaagtcttcgaccactttcacaatcgttcctttttgttttttcacttttgtaaattgcggactaattttttgctttaagaatgccttttgtgagtcttcatccgtcagttgtttaagttgcgctagccaacttgtctcaacaccacagactttatagagatcaccctttttatttttaatgcgtacaatacacatgtaggcaacggtcttccccgagtacccaccatagagcgcagttggtcgatcttgtttagcgggaatcaattgcttgccgccctgcccacttgctttatcatctttagccgcatagagcgtttgattaaatagcgctcccgaattttcatgcacttcgcgagtcactagaatcttcttaaactgataaattttattcaaataagctagaccggattctttatcccaaataaccgcttcagtattttcatcaaccaattcgtctttctttagaccatttaaaaaattaaagttacgccacttatcttgctgacttgccttctgatactcaccgtatacaaaataaggttttaatttaggatagcgcttcaatagatacagaccaacaaacgcggtcagataagcatcaaatgcatgatggtggttatttagattacgatttttcggaaaatcaaattccgttcgcatttggtgggttaacccactcttaaccgtaattaactcaatattgtcttcaccatattgtttcatcaatagatttgtcgctaacttaatgacttggcgtgtttctactaattgccggttaataaaacccttcatggcgtatttactgatatgatccggatttaacgttaaattatcatattttttcttggtaattaacccagctcgcaacatctgttcccattgaatctgcatcttttgtccaagttcgacacttgtaaagtcggtcggtacttgatctgctttactacgattcattttttgagaaactaatacccgattatctagtgagttatccttaataaacgattgtggcaaaatatgatcaatatcgtacgtcgataaacgatcaatattcaacgaatcacccgtatacatatcccgaccaccctgcatgaagtacaagaataagcgcgtattgctcaatgcagaattcgataaatccttaagttcatttctgatttcagtattatttagcaattcattgctgatattttgatagacttgttcaacttggcgcttacgttgcaccgaaagtcgtggattcacttcatcttcgcgcgcaaattcaatcaatatccgttctggcgcctggcctttcatggccttttgaatgtcattgacaacaagcagaatctggcggagcgcttttttattctgtggtgacgtatataaatcattgataacatcttgtacatcattttcagctagcatcatttgattagcttcagcaattaatttatcaaagtcttcagagtgcacaatccgcatgaagttatccgttgtatcccagagtaagtccataattcgttgtccattcgcattgacgatttgcgttaataatttagccgacaaacgaccccaaccgcggtagcgtttagcagctaattgcacacgttgctgatccgttaaccaatcgatttcattcaatttggcgctatatattttgccgtcttcaaaaatcgttgaccattcaatacatttttccaaatcggcttgtttatcaacatcatcaaccgcatctccaacaatcatctttaagtcatgatacgtgcttaatcgactattaaatttgttctcatcggatagaccagtaattgcgggacgacttgcatagcgcttttctgataccaagtaatcctgaatatttttcactgttacacttattttttgcacttattccgaattgataaagttatcatacgatgttaagcgtaaaaaagcgacgattttaagatcagatgacaaaagtgttagccgagttaaggccattgtcacctaatgtttaaattggcggtattgtgcttctaaaacagcgctatctaagatgtgacctcgcattgccgctgtcatttgatttaggtaaaagccaggctgtaaatcgagcgtggtatcaagtgcaaatactttaagtgtataagtgtgatcgcggttagggggtgtcatcccgccgtagcaagcacttgcttctgttgataaatggtctgttttgggactgtgccaagtattaacaccttggatgaaatcgggcgcttgttggctagcattagccgcgacagtggtcgtttttaaattggcaagtgtccagtgaatccaaggaaacccttgtgtcacttcgtaggcatctaggtcgtagaaaacggcagcataactgactgtatcgctaggtgcgtcttgaatgtcaaacggtatggaataagttggcacgccttccacgttaaattgagtgccatgaccgccgtagaggtcgtcgaagtagccgtgatgaatgccagaactgataatttgcatgttgagtctcttttctgttttagattttagtccagtcgtcaattgagcgaccgtttgtgtcacatagttcgagccaactattggtgccaccaaagtacaagaagaggccgatttcattcacgctcttgaaaacaatgtcttcagtcgtttgattgtcttgaatttgcgctgcatgttcgttgcgcaagtgagtgcccattttagcagcaaagccaaacgagccatccttattaagtggcgcggttggccacaattgtgcccccgctttcaataacatctctttgcgcttttgccagatggctgttccttgtgcttcgcgcgtagcaacagtgaattcgatttggctgacggcttttgtccatcgatgacgtgttttagccggttttgctttgactggtgcgcttttggtcaggggataaccaaagcggctgaggaccaagatgatggcttcaacggctggagctaaggttgttcggaaattttgagggacgttggacggaagcgaggtgctcgttatcggtggttgattttgttcggctaatagctgccctacgtagccaatttgttcagtccactcaggatccatggtaatccagatacccgtgtcaacttgatcagtcgaggctgtttcaagtggggagagttgttcgattaaatcgacgatcgtttgggtagccgttaatgttgcattaatttccaaggtcataggaagcctcctgacagtctttgatgcttctaattaaacactaaatcgctggttttgtcagccagtaagaattgattgaaggaatgcttgaaactgagattcaattaaccggaattaacgaatctttgttatgatagaaggtaggaattttaacgggtgggagaaatggcatgcaagcacaagcggtactaaaagaaaaatttggttatgatcactttagagaaggtcaagcagatgtgatcgaatcattgttggcaggcactaatgtcttggcgattatgccaactggtggcgggaagtcattgtgttatcaaataccagcattgatgctacccggtttaacgttggtggtatcaccgttgatttctttgatgaaggatcaagtcgatgcgcttaatgaaaatgggattccagccacgtttatcaatagtacgctaacgcagggggaagtccaagaacgctttaaccaagctgcgcgtggtgaagtgaaattactatatgtttcgccggaacgcttggattcggattactttttagctgatttagctgaattaacgattgatttgattgcggtcgatgaagcgcattgtatttcgcaatggggccacgattttcggccaagttatctacgcctgacggatacgattcagagtatgcgccaacgaccaacgattgtggctttaaccgctacggcaacctcgcaagtggcagctgacatcatgcaacggttgaacattcagcacgaagttaagacggggttttcacggcagaatcttgcgtttcaagtagttaaaaatcaaaatagtgatcgctacttaatcgattatttaaaggtcaacaaacaaaaatccgggattatttacgccagcacacggaaagaagttgaacggctcacgaagctgattgaaaaggctaagttaggtgtgacaatgtatcatggcggattaaacgaaatggtgcgtcgtcagaatcaagaggattttctctatgatcgcaaaccgataatggtcgcgactaatgcgtttggcatgggcattgataaaagtaatgtgcgctttgtcgtacatgcccagattcctgggagtttagaggcttactatcaagaagctggtcgggccgggcgtgatggcttgccgagtgaagcgattctattatttaaagtgaatgatgtgcagattcagcatttctttatcgatcagtcggaaatggacgaagcgcataagcaacaagaatatgctaagttacaagaaatgacacagtacgccaatacgcaacaatgtttgcaacagtacatcgtcaattattttgatgatgattgtgaagcgtgcggccggtgcagtaactgtctggatacgcgtgaggaacaagacatcacgattgatgtacaaaaagtcttatcgtgcgttaaacggatggatgaacggtttggcaaagtgttggtggcgcaagtattgacgggctcgaagaatcaaaaaatcatgcaattccgctttgatgaactcccaacgtatggtctaatgcgtggtgattcgcaaaaagaaatcagtggtttgatcgattacttagtcgcttcagggtatttgcaagcttctggcggtcaatatccagtgctgcaaatcacggcggcgggagttgcagtcttaaaaggccaagcgaaagtgacgcgcaagatggcggtcaaagtgcaaaaaacgttgcctgaagataatgaattatttgaacaactacgtgagttacgccgcgatttagcggaagaacaaggtgtgcctccgtttgtgattttctcggataagaccctatattcaatgtgtgaaatcatgccaacttccttgcctgaaatgctagatgtcaaaggggtcggcgaaaataaactagaaaaatacggcgaacaattcttggatatattaatggcagaatagagtgctgagcattgactggatttaccaaattggcgatgtaatcgctgatttggtaaatttggttaagtgcagaaatatgctggcgagaacacgtttcaacaaaaaagcgtcaacggattctaatatccgttggcgcttttttagtatctagtatggtgcatctgctggattaccatattcaaagtgttggtttgactttggattgggtttcgcatcaggtagtaaacacgtataacgtgtaccatcaggaccttcagctaggaagatgcgagtaaaatcattttcagtttcgatcagcttgcagttttcgtgggttaacccataaacatcagttacttgcgtaataatcatctctttttcttaatttgaaaggagtagagtaaccgtacattctaccaccgacttaataataagtatagacttttattgacaaaatttcaaattaatccccttatttggtttgagtttcaagctggtggagggtttgtttcaattcaagtccgccacgataccccccaatttgcccgtctttacggtagacgcgatggcaaggaataatcatcaatagtggattgcgaccaatggcagaagccactgcgcgaattgcggtggggtgcccgacttgagccgccaaagcgctgtaagttgtggtttgatcatatggcacagcttgcagggcggtccaaacacttctttgaaaaggtgtgccgccgataatatcaattggtagtgaccacgtggcttggtcaccatcgagataagctgttaatgattcactataaggagcgattgcggcttgatttgcaactaatttcgtttggggaagaaaagtggttaattcactgatagtgccatcgggtgaaccaacaaaacagatacctttgggggttgctgcaataataaatgattggccagcatggctaaaagagccatagaagattgttagcatttagaagccctccttttgattgccctcagtatagcatgcccgttaaaaaacgaccaagccgtaaaacaggctcagtcgttttttacttggttaagcaactggctgaaaggttttattttgaagatgatactgaacatcacaacttgctgcgacttctttttcatgggtgacaagaatcacacatttttgttgttgatgggctaattcttggaagagatgaatgatctcctgcgtattttgttcatctttgccagatgggtgtcgtttttttatttgaccgcctgtgttttaaaaacagcgatttgatttaaaagttcactaatgcgtattcgatgactcttttgttgttgacggctcgttgtgagtttctgatataagtttaactcatcaccctcgttgaaggcggtgaccatggcttcagcggacgagacgtaatcagtcattactaattgtaactgacggttaatttctcgtaattcttttggcggatttagtaatgtgacttgatcaataaattgtttaaaaacccgtaagttatgttgaaaatattcgtttaacgattccaaattttcgtccaccagacagcgccctttgatgatgttcttgctggtctgggtgtactcactaaatactgtttcaaacacgataaaccgttctaaaaattgattccaccgtacgatgtattcctgagtcgatagttgatccgctttgacactcatggtcgttccccctttaatataatatctaaatactcatcatgcgtataaatatatactaaatatagataaaaggctaattattagcctttgttaccgataacgatttcaaattgcgtttcattttacaaataaaacatgacgtcctataattgaggcaagccaaaaaaaggatctgattacttgtccaaccaacgttatctatctggaacagcactaaaactatttacattcaccctactagccggcacgttcacaatgtctatcagccaatctgccctttcaactgcttatccaactttaatggcctattttgatttatcagccacaactgttcaatggctgacaaccggttttatgctcgtaatgtgtgtcatgatgccgattagtccttggttattaaacaacatcccattcaaacgactctacatggggattttaagtttatttgctattggaacgctattaattgtcttcgctaatcagttcggttgggtattgttcgggcgggcgttggaagccatcgcagtaggtgttttatttccatcgtttcaaactgtcttattaaccattactgctgaaaatcaacggggccaaattatgggcctggctggtttagtaatgggctctgcactagcttgtgggccgattatttcagggattattctcaactacttcagctggcgaggactattcatcgcctttattctgattatcttaaccgtgttagcaacagctaacttcactatttctgatgttatgccggctaagccctatcaccttgatggtctttccgttttatgtacgactggattaatcggtttattatatgtcatcagtagcgctaatcatcctactatcaacccaatcggactctggggtatcggattagtgagctgcctagcactgggttattttgtctaccggcaactcacccagacaacgccacttcttaatttacatattctcggttaccttaactacgatattgcggtcggattgactgctatttcctatatttcatttattgtcaccacagtcatctacccattatattttcaagctcaattgaagttgacaccgctcttttcaggattagcattggtccctgctgccgttgtgttaagccttttgaatccactcgcgggccggttagctgataaaattggctttaaaccgaccttactcgttggcctaaccatgattagcattggatggctagctttgattggcttctaccaatggctgtcattaccattgatgatcctgtgtgcctgtttcatcgaaggcggcaacgcatttgtcatgatgcctgctgttacacttggtgctaatagcctgccggatcaagtgctcgctgacggcactgccgtcacaaccacggttcgtcaaattgcgggcgcgctgggcgtcacccttgcaactctccttttaagtgtcgccggttaccaagtcatatttgttagtttgctcggcctgaccttaattggtctcggcttagccactcaactacacccaaaataagccacactaaaaagcaggttagcgatgatgattgtcatcgttaacctgcttttttaatgccggcgttgcttaattaggataagtccccatgtcattaaactaaatgttgaaatgattgcgccgataattagtcccggcgcacgatagactaagcgaacttggttagtccctttctcaagtggcactgcaagcatattgcccatcactcgtcgtgtacgaactgtttgatgattgacttgcgcatgccaaccactgtcatatggcacacttagataaagtaattgatcagcggtcttagctggtactacaccagcaatccgaccattatctgccgacagttgttttaggtcgatctttaagcgttgttgtgccaactgatcaaaagcttgatcgaaatgagcctggtctaaactagccacctgaatcttacgaaaggctttaggttgccgactggtaattgtcagcgttagttgttgacctttttgatagcgacccaaaccaataatcgtggtcccactcaattcaatcggtgctttacgtgttcggccattaattttcactttcagctttgataagttttgttgcggcaagtatagataagcatatccacttgtcttaacttgcgttgtaaacgtaatttgccgacgtttttgcgcttgtaaatctaattgattatattgataaaatggtgtcgtttgtcccgtcattgcttgcataattcgatcttgattttcaaacggctcatgggccttcaaagcaatccgtgcaagctgctcattaaccgcaaaccctaagcctaacgttttatggggttgtgtcacaacctgtccttgcttagcaattaggtcatattgattggcaaatagtaggtcagtcagcacagtatgcccaatcccgttaatccgccgggcattcttactataaaaaccgagattaaccaacatcgtccgcatccgctcatcaagtgtcgaagaataattgtttaatgtatactgtccaaaggtcaacgcatcattgtacccataatacggttccttaaacgctttttttaagagaatcgcttggttattaacgcgatagaaatcaggtgtttgccgttcaagctgttcaaagagtgctgcttggcgttggtattgttgcgcataaacaacttgatcgcccatcggtaacttagtggtcgtcaagcggccattaatcaccagttcactaaacgtcaatatggcccccagaccaatcacccatggttgccaacgtgctcctttttgccacgctgcaaaaataacgctagccaaaaccattagtccgattaacaaccagagcgattgtttctgcacaccacgtacatgcggcccatagtagagcgccaactggccaatgctgagcagaccaccgactatcaaaataaccaggcgtttcgtttgacgtttaccaattggttcaatacttgcttcacaggcaatcttgatgagaacaaatgccatcagataggtattccgatatggaaacccttctggctgctggaacatgtgccacatcgtattaaatgtcgttacccagaaacttaacgctaaactaacaattaaaaagccgttcgaccactttgcttgccgtcgaatggttggtagacagaaataatagaccgcaaataatagtgctaatgtactgataaataaagttggttcatgaattaaacgttgcgtataatggctgccaccgacttgaaattggctcaaaacttcccagccaaactgcggggttggataaaaactggttgcagcgattgtctttttcccagtcttcaacattccaagtaacgacggcaataacacaactgctgttgtgccccccgcaatcaatgacgcccaacaaaactgccagatagcttgccgccagtgaaccactagttgccaccaagactgttggggttgtttccatttgattaacaaactaattgcatacaaaacggcaaatagacatgacatataacccaagtaatagttggtaaagatagtggcaaccaacatccagatatataagccaggatgcccttttaaaaatagccgttctaatcctaagatgaccagtgggaggaaaatcagagcatctaaccacattaggttataaaagttcattgccacaaagccacttaaactataagctgttgcaaaaattagcgcggaaaaatgatattcaggctgacgcgtctttagaaaatgggccatcgttaaacccattgccccaatcttcaaaataatgacatacccaaccaccactggcaactggctattcgaccaaaataggagcagtaaattaaaaggactgattaaataataaatcactataatcgttcaacacaaagaaacggccttactccagatgaatactggaataaagccgtttaggaacatattaaattttatattatttcatccggcaacttgacaggaccctagtacatagcttgagtggtggttctttttttattttagacattagttcatttaattaggaattcagatagggaaatatactgaaatgaacgtaactgataaagtcggtcaagagtggcaatttatactaatttttgaaattacagataaagaagctaatcagggcaccgttgatttgaagaaagcaattaactgaggtgtcttactttaattgcctagcttgtttagttgacccacttgtctagaaatgttaaattgattctattcaataaaggcgttgattgttaggaggcgatgaaagtggatgaacgcattacagaataccgggatgcggtttatgagcaggtggtcaaagtcgggaagtcgttagggaacgtgacgcgtctacaactgttgaacattcttgcgcaaggccccaaaacggtggaagtcttagccagtacagtcggcttaagtgtcgctaccgtttcacggaacctgcaaattttgaaacaaataaacttagtggcgattgaacgcgagaagaattttgttacttatcgtttaaattcagaacgggtcaaacaattggtaaccctcttggttgatgtctgcgaagaaactttgccagagatgacgattttggaaaaaacactcgcgcaagaaacaggtgcccccgaagcgttaactggtgacgcattgaaaacgaaattaatggcagacgatgtgtgtttgattgatttgcgtcccgcagatgagtttgcaagtcaacacttaccaggggcacgcaatgtgccatatgatcagttggatcaacgattagctgagctccccaaggataaagaagtggtggtttattgtcgtggtcgtctatgtgcttacgccaatgttgccagtcaacaactacaagctgctgggtttaaagtggcaacgtttaatcaatcagtgtgggaatggtcgcgagttatgaccgaaacggaataagatgaagcgtcctttttgacggcacgtcccaatggtggtatactatgagtaattcaatgaaatcgttgaatgattttcttgaaaagaaaggtgatcgcaatggcaacacaaattctaactgaagcaaactttaaagatgaagttcaagaaggggtcacattagtcgatttctgggcaacatggtgcccaccatgtcggatgcaaggcccaattgtcgaagaactagccgacgattacgcgggtaaagctaaaatcgccaaagttgacgttgatcacaaccaaaacttggcggctgaattcggcatccaatcaattccaaccttgttggtcatgaaagatggccaattagtgcaacaaatggttgggttacaacggaaagaaacattagcacaagaaatcaatactgccttagcttaaaaatagcttgaaggcgtatcacgattaaataataacatcatccgataagctcttaagtagggcatatattaggtgatgtttttttgtgttgttattttaagtaatccagcataacggctttaaagaagtcgatgtgtttgaggtacatttcttcatcaacatattcgtcaatcatgtggctagtatcattgccggggccgacaactgccactggtaagtcaggattgtgcttagcaaggtgggcggcgtcggtaccgccagcaacgtgcatcagtggataagcttgggataacttttgtgccccgattttttgaacagcttgaatgaatggtgcttgtggattgctcttaacgggtggttggttattaatgacggtcaattccagattcatgtctacctgttgattgagttccgcaatgatggtattgaggtcagcaatcacttggtcgccagttaaggcgggggttgtacgaacccgacaagtaagttctgcgtgaccggggaccgaattaatttgttcaccaccgttgattaaggttgtgacaggcacgatatcgccgaggacatcatcaataggatgtttctgatcgaagtattgtttttgccgattgtagtaggcaagcaaatgatcaatggcgttaataccgagtgcgggcattgaactgtgcgcggttttaccagttgccgtcactttaaaatcaagggaaccgttatgggcgaaaattaagaaatgttgttcattggtttgattagccgcaaggagtttttgggccatttctgtggggaatttgtcggggttatttgccaaggcttgtttatcaacgccagatggttcggcaactaataaggctgttaaatcatcggcatagccttgagcggttaaagtttgcgcaccagtttcgttcttttcttcatcgacggttgcgagtagtttgatttggccgtttaaaggaacatgttcatcgtgtaattcgatcattgcaatcacaagcgcagccagaccagacttcatgtcggttgcgcctcgaccgaagagtttaccatcgcgagcggttagagtgaagggatcactcgtccatttgctgcgatcaccgatgctgacgacgtccatatgaccagtgacaccgaggaatttgtcggttgcttcgcctagataggccactaagttttcgcggcctggtttagaagccactttttcagtatggataccatgttgtgcgaatagatcggctaagtagtcggcaatcacactttctgcttggtctgttgtatcaattgagaccagtttttctaaaattgcgattttttcagttttttccatcatcaaaagacctccagataagattcaatatgcattatagagcccctattttgggaaagcaacggacataaattaagcaatttcgcaaatcaagtgggttaaaaaagccgtcacgcttagcgtggcggctttttattggtctggttggtgagggcttctttaaaagcctgaccggcgcggtttattcgttaaaccagtgcatatcaaacagaacgcatggattggtgccggcgcaacgattttaccgggggtgacggtcggtgagaatgcgattgtcgctgctaacgccacggtcaccaaagatgtaccagacaatatgattgttgccggaacgccagcgagagtcatgcgtcaaatcaaattagaaaaagagttttaacatgtcaattcaaaataaagtcgtgatcattacaggtgcctcatcagggattggggcagcaactgccaaattattagcaagcaaaggggctaaggttgttttagcagctcgtcgtgaagatcgtttacaagctttagcatcagaaatcggtgcaaatgcgatttatcaagcaacggatgtgactaatcgggatcaaatggcgagcttagtccaattggcgcttgatcatttcggtcgcgtagatgttttatacaacaatgccggcgtcatgccacaaggaaacctgagcgaacgcgattatgatcaatggcaaaagatgctcgatatcaacatcatgggcgttttaaacgggatcggtgcggtcttaccaacgatgcaagcccaacaagatggtttgattatttcaactgattcggttgccggacatgtggtttatccagcttctgccgtttataacgggactaaatatgcagtgcgcgctattatggaaggcttacgccaagaagaaaaagataacggcattcgttcaacaattgtttcaccaggggctgttaaaacagaattggtgaatacgattggcaaccctgctgttttcgaaggggttaagcaattaatggatgcaccagaagaatcagcgttggccctcaatccagaagacattgccaacgcagtcttatatgcgattgaccaaccaaaacatgtagtggtcagtgaagtcttaattcgcccagctaaacaacaagtttaagaaaagtggtcgactaagcgggtagtgcgtgcggattagcctaagcaggcgaataactgatgcagtcagtggtttgactgatgtagctaaacgtaaggcattgcttcgacgagcgcgtttcaaaatggtatttagtaactgagcataaaaaaatcaccttaatctgtttttaagattaacttatcactaaaaagacgacaacattctttttgaataaatgttatcgccttctttaaatatcgtatttctcatggtctcgataatccaactgcacatcatcaccattgctctgtaaaaagtcgattctatcttcgccccacttggccatcattcctaggacggaaaccaatgatttgccgtacgcagaaatcgcatactccacgtgtgggggttcgttagaaacttttcgagtaatgatgccatctcgttccaattcacgtaattgatcggttaaaactttggctgaaattccctgaacgactcttttaagttcggccggtctttgaggtcctgccacaagatgacagagaatcaacggtttccatttcattccaatcactgataaagtcattaaaacaccgttggtataatttttttgtggctcgttcaaggcctttcctccacttcttgatgctgatttgtttgtctatcataccatcaaaaaaaggatcaggacaatcttatctgtcctaatccctgattaattattctggtcgataagccgctttagcagcgttcatcgccgaccatgccttaggccagccgacataaaatgataaatgcgtaatcacttcgacaatttcagcttcagtaataccgttttccttgtcaatctttaaatgcgctggtaattattcaaaattaccacctgaaatcaaggcactgatggtgattaaactccgttgatgtgctggtaactctgattcacgcgaccaaacttgcccgaataaaacatcgtcgtttaattcagcgaatttaggtgcaaaatcacccaatagatcgcggcctgctgtttgtttctttgccattttaaaaacccctttctgaattaaagtgcgtcataaagcgcatttgaaacagcttctaaccattctggtgtgccggcagtgatggcgacatgactaaaccagctatccttagtggccccatgccagtgtttgatgccgtctttagtaacaatcacatctcctgggactaagtgttgtgctgctttaccttcttcttgataccagccttcgccaccagtcaccaatagaatttggtacccagcatgatggatgtgccaattgttccgacaaccaggttcaaacgtgacattcccgacaccgacattcacgtctggttcgctcactaacattgataaataactttgaccgacgaagaagtcttgataagccacattagcttctccaactgggaataattgtttttcttttaattgttcattcttgaccattctaataacctcactttattaggattcaaatcgttgtaaatacgtttcaaaactctctgcttgatcgatactctgatccaatttaccatcataccaatcaattttacgcgttaggatctgtaaatttgcttggcgctcagccaattcggcttcagcttgagcctttgttttttgcaataaagctttgcgcgcttcaatcgtcgcgtctccttgagcccgcaatgcaacatattgctttaattctgtaatccgcataccggtccttttagatggagtataaacccgacccacttaacgtcctctaatgtataaaagcggacaccggccgcatcgcgttgcggcataatcaagccttggtcttcatagtaacgtaatgtgtaagtcgacaaaccaactaatttagcaaactcgccgattttgtactgctcttgtgccatcgacatccctcctacaaaaatagcttataccttagagtatactataaggcaagttttttaataaataggacgatcgccatcaatattcggctgattaatgccccaacttgccccaattcctttttcaggatgattaactaaatcaacaacaacttgcgcgatactccgtcgtgaaataatcgtccctttaaacggtgttcccttttcagttaattcgtaatcgatccgatcttcattggtcatataggcacaacgtaaaatggtatagttaagcgaagattgttcaacaatcttcgccgcccgccgcgtgtcttccatgacttcatggccgactgcttgttcattccactcaccaaaagcacctggcacttcatgatacaagcctaatccactgatatagattaatcgtttgatgcccgctgcagtcattgtcgcgacaacgttttgcattaatggttcgaactgcccgcctaaatttgcgtaaacgatatcgaccccagctaaactgtctgccaacagctcttgatccaacacatcaccttcaataaccgtgacatgtggattttgtgctaatgcgcttagccgttcagcgtgccgtaaatatagcacgagctcatgttgattttctttcaacagttgctcaataactaactgggccacttgtccggctgcccctaatactaaaatgcgactcattttaatcaccccttcttcaatgtctttagcatattccttaaagtacactcgaaggcaagccatttttcaaatttaattggtctaggttgctacttgactttcaaattaaattgactaaaatgaaagttgttattaattataatcattataaagtaataaaaagtattggaggcttcaccttgtcaaaaaaattatcactcgcccaaaaaattaacgtgatgcgggctagcgtcatgggtgccaatgatgggattttatccgtcgccggaattgttatcggtgttgccggcgctacaagcaatagcttcgccatcttcatttcgggaattgccggaatgattgctggaacgatctcaatggcgatgggcgaatacgtctctgtcagcacgcaaaaagacgcacaggaaatggcaatcattaatacgaaattgaatttaaacagtaattatgcgtctcagatggcttttgttcggcaaaaatacgtcaacactgggattgatcctgaacttgccgatcgggctacacacgaaatgatgactgctgatccgttgacgactgtcgtacgtgaaaaatatgggtttgtcccgactgcttttaccagtccttacgcagccgctgttgcgtcattcatctcatttccaatcggttctattttgccactagccgcaatcaccttattaccccaaaccattcgcgtgcaagccaccatcattgcagtgatgattgcccttgcgctaaccggctacagtgcagccgctctcggcaaagcgaatcgttcaaaagccatgttgcgcaatgtgatttccggattattaaccatggtagtcacttacgctattgggacattattcaaacaataatcgcttagaaaggatttttttatgacccctcttaaagccccactcaaaacaactgaaaaaccccatcaaacgatggaagaaaagatgaatacccttcgagccggcgttctaggttctaatgacgggattctaaccgttgtcggtgtgctctttagtgttgccgccgcaacaaccaataatttcaccatttttatcgctggacttgctgatttattagcctgtgctttttcaatggcggcgggtgaatatgcttcagttagttcgcaaagtgacacggaaaaagccgctgttgccattgaacaagcacgcttaaaaacagctaaagatgatcaaattaaagaagtccaagctttttacgaagccaaaggtgtcacttctgaaacggcactcgcaatcgctaaggacttaatgcataagaagcccttagcaacaattgttaatgttaaatatgacctagagcttggccattatatgaacccgtgggccgcagcgtttgcatccctcttctcagccgctttcggtggcgtcttcccccttgtgacaatgattctactgcctgaagcctacaagatgaccggtacaatcattgccgtcaccatcgcggtttccattaccgcgtttatcagcgctaaactgggcgatggcaaagtcaaagtctccattattcggaacatcctaattggtttaattacaatggccattcactacgggattggccaactcttctaaaaaaatccgtcatcatttgttctaatctaacttaaattcagccacaaaaaaaggcgtcaagctaaagttaacttttagctgaacgaattaaaatcgaaaccttttgtgaactagggctgtccaatatccaaatgggcgttcggattaattttacaatctaccataagcctaccgattttttaatattattttattcatcaatttccggcgccgacccaagctctgcctgaatcatccagattttcttctcaattgcggttttgagaccaatgaaaatatcttgggtactgaagtctttttcaacatcggatacttcaatgccgtgttggtaaaggtcttccaagtaacgatagccatcaactaagtgtgcgaggcgttctggggttgttttgtcccattcaccaggccagtcttgaatcttagtgttttcggccatttcttttaaggtcgagtaaggactgccatcaagcgcaatcagccgttcagaaatgacatcgagttggctgtcaatttcttccatgaactcatccatcaaggggtgcaacttcaaaaagttgggtccacgcatgtaccaatgcgtctgatggataatcattgacatctggctcaaatcggcaacgagttgatttaatactgctttggttttcgtatatttcattagattgatctcctttcgatatggttattataacatagtggtagcttaatctgaaacgttatacactggcaaattaagttatttatagcccgtagaattaagtcgttttgaaaagatggagacgttatatggtagattgtaaaattaatctacaattgaattttatttaccttatgaagatgttcaaaacgcgttaaaggaaagtgcgcaaaacccctttatacgtacaaaggatgaaggggtagtgggtaacaatgagtgtaaattaaataaggcacaaaaaaggatgcttaaggataaagaaatatataatcatttcaatttagaaaatattcccagttccatcaaaacggagctaaacaagatagtgcatggcatcgatgactaatactttaacaccaaacagaaaggggctatgagtatatagggtctataactaacattatcgcccctctaaaacattattaaaacaacacccattatctattggttagataacaggggttgtttttttgttaagtgatataataaaccataaaagaagtttagaaatacggtcgtggtcatcaataaataaacaatttaattaattaattatttatttaattatttaatttcagaaaggtatacatgactcatggtgcaacaaatcgtactcccaatcaaagactctaacgtcttaaaaatggtgcaagacaccttattagatagttttcgggcgggtcgccgtaactacaccatctttcaagttggcaaagctaccctgctacggctgagtgatgtcatgacgttaaagaaatcagatatctataatccagatggctctgttaaaaatacggcttttattcatgataaaaagacgggtaaagcaaacacgttatatttgaaacccgtgcaacaagacttgttgcactatcatggttggctggtacaagaaaacatcaattctgagtggttatttccctcgacagcccatcacgatcgccatatcactgagaagcatttttataaggtgatggcgcatgttggtgatctattagacattaactatttaggtacccatactatgcgtaaaacaggtgcttatcgcgtctatacacaatcaaactacaacattggcttagtcatgcatttattgaatcactcaagtgaagccatgacactgacttatcttggattagaccaagctagtcgcgaaacgatgttagatcaaattgattttggttaacctataaaaaaattttgctcgtatacggaaaatccggattgctttatttctagggcataatccgagataatcaagtataggtttttttattatgaaagctaagagatactcaactgaatttaaatcatcaattgttgccttgtacaacgagggtcgtactgctaattcgctggccaatgaatatcatttggctgtacaaacggttacgggctgggtcaaaaatctcaaatcaatcccaactgctcttatactaaaaatagtccatttttttagtataagatcataaattagggcctagtacttttggaatggaaatactttccaacaccaaaaattctagaccagattatttttgttaaacgagatttctatatataatggaattataaatttactgttggaggtttttatgactgatttatttgcagatgggactatctctatccatggagctcaagaaaataacttaaaggatgtcagtttagatattcctaagcataaaacgactgtatttgctggtctttctgggtctggtaaatcctctttagtttttgatacattagccgctgtttcccgacgtgaattgaatgaaacttttcctagtttcacccaacaatatttgcctaaatacggtcaacctgaagtgaaccgaatcgacaacttaccagtggcaattgtggttgaacagaagcctattggtcgtaattctcgatctactctggcaacctacaccggcatctattccgtcttacgtttgatgttttctcgaattggacagccttgggttgggtattctgaatggttttcctttaacctacctcagggaatgtgtccaaaatgtcagggattaggctttgttgacgacatagatgaacgtcaattaattgatcctaataaatcactcaatgaaggtgcaatgacttttgccggttttcaaccgggaacttggcgttggaaggaatatggcaacagtggattatttgatttagacaaaaaaattaaagactacaccgatgaagaatatgatttattcatgcacgctccgcaacaaaaattaaaaaatccaccggcaaattggggccgtacggcattatatgaaggactagttccacgtatgcttcgctctgttattcatagtgcctcaggtcgtcatcatgaagctgccttatcaaagattgtcactcgaaaaccttgcccagtatgtcatggaacacgtctgaacaaaaaggctctaactggtaaaattgctggcaaaaatattgcagaagtcagcgatatggatttagtaagtgtcctaaaatttttggataatatctcggaccccaaggctaaaacaatggtgcgtgaactacatagtaaagttcaagctttggtcgacatcggtttaggttatctttcccttggccgtggaactgatactctatctggtggagaagctcaacgaattaaaattgccaaatatttgacgagttccctatccgatttagtttacgtactcgatgaaccaagtgtaggactccatcctcacgatattaaattaattacccaatccttaaaaaagctcaaggaacatggcaataccattatcctagttgatcacaaccctgccattatttcgacagcagattatgtcgtggaaatgggaccacaagccggcaaaaatggtggtcaagtaactttcactggtacctacgacgaactattacggtcagatacgattacgggtaaaatgttacgagaaaaaatcactttcccaaagcctcgtgaacctcaatcttggctaaatgttaatcatgtaacttctcataatttaaaagacgtatctaccagaatccctcaaggtgtaatgactgtgatatctggaccagcaggttctggaaaaagtactttagtccaagctttcaaacaacaagtttctgatcaagactatattgatttgagtcaggattctgtaggtttgaatattcgttctacacctgcaacttacttgaacattttaaatcctctacgaaagcttttcagtaaagccaacaatggcgtttcaacacaactatttagttataacggtaaaggtgcttgtccccgttgcaaaggtaaaggtgtgatgatcaccgagatggcattcatggatccaatcgttcaagaatgtgagttgtgtcatgggtttgaatctttacctgaagattaatgatattttgcaaaggtgttgtgaagaaagacatcagggcattataagtaatcaattgtccaatagacaagctcccttcgattactaagtacgtacctacccacaataacgtagtagaacctaatacttgaagtgccgtttttaggttcgattgcaggttatcaagattcgcatttttgaatgacttatccatcatctctttgaattgactctgaactttctcaaatacttgatctgtcgcattaaaggactttattgtctctatccctttcaaactttcaataatctgagaattgactacagcactagattccatttgctcttcatttgttcgatcaaatggtttcataaatagaaagacgattaagccgtaaattggaagtgtactgaaactaattaaaaacaaaagacgattttgtaaaaacaaagaagttccaataaatataaccattgacacatctaaaaataaggatagtgtggcattcgccaaggcatcgataattttattggcatctaaaaatcttgagacaatctcccctgattttcttgttgaaaagaagttcattggtaaattcaaaacatgcttgaaatacctcagcataatcgaagaactcagctgttgtcctaacctaattaaaagatactgtttaaaatattggaatagtgtttgtatcacatacattgataaaagaccaattgagattatttctaataagttcacagatcttgagggaacaattcgatcaattatcacttgaaaataataagaacctatgatgccaaacccagttaatataaaagaaagaaatacaataccagcgattgtcttcttatgacttgccaataacggcacaaaagagaataaaccattggatttatcttgtgtgggatgataattttcagtaggagcagtagttaataagattcctgtccatatagaagcaaactcttttggcgttcgttcaatttttcctttagctggatcagccagaagcaacttcccatttttcattccataaacgacaacataatggaagaaagctccatcaatgattacatgggcaatcaatggataggtcacttcttcttccttccaaattgattcatcagtttgaaaaacctgcgtttgaaattggaaatcatttaatgcttgaactaatccaaaggctgaggtaccctggctgtttgtccctgacattaaacgtaatttactgataggaacgctcgtatcataaaaatttaggatcatagaaagacaggcaacaccacaatctttttcatcatgttgcttaaccaattttatttttctcattgtacttacaccttctctagcgcttaacttaatatggtgtaaatatacttgtattcatagaatattattcagaattgtcctgaaatctctcattcatatcctaaagtgaatagaattacagctgaaacgataaataagtaaaattacattaaaaagacacagatggataggttcgtttacatttcagtacaaaatattattatcttgagacaatttacattaacaattcaattcgaatgatatatttttttcgtaataaaaattatatgggaggttttactatgaaaaatgttcaaagtttaagcaaagaagaattggtacttgtagtcggtggctatactgctaaacaatgcttgcaagcaattggcagttggggtatattgctggtacaggagcaggagcagcaggaggtcctgctggagctttcgtaggcgcacacgtcggggtcattgctgggtcagcggtatgcattggtggatttttaggacaataaggaggatatgaaaatgaaaactgcaaatattaaattattaacaaaccaagaaatgatagaaatttttggaggtaaaactaattggggatcagtcgtgggtagctgcgtggcaggtggattagtcggtgcattgggtggaactccaatttctattggagccggatgcttagtcggtgcaggacaagattggatttcacaaaaataaatctttataaggaggattactatgccgaagaacgaaaaaaaggatctctttttaactgcttctatagcgataattgggctgacagcaatatacttttcaaatacatttttgaatagtttagcgatgtcgtttttattaatcggcatagtagtcttaactactctaccagttcaaatcagaaaaaagaaacaacgcagattaattacggattatttaaatagaatcgatactactttacaaaaaaatatttatgaagctactcaagtcactccgaaccaattaaaaaattatactgtactagggactggcatagcatcttctaagctttataaaattgaagaaatcatatcaaagatgtagatagcatgttcatttaatcatttagtagtatttctattacattataattgatgaaaatagattcttataggcagtatttgaaccaaggtagatggtcgttgaatacaattttcgatgtacaaaaaaataaagatggagtgtgttattatggaagcaatcaaaaaattagatttacaagctatgaaaggtattgtcgggggaaaatactacggtaatggattgtcttgtaacaaaagtggttgttcagttgactggagtaaagctattagtattatcgggaataatgctgtagcaaatttgactaccggtggagctgctggctggaaatcttaacattctttggtatccgccttttctaataccttttttatagtagatttttcaattagtagtaatttaatctactgctttatatcgaagaagtattgaataaacatatgaataattattagtaggtgaaaatatgtctaaagttaaatggttttctggtggagtcgaaagaggtaaccaagcagtacaaattattaatgaattgcttaacgatgacaagataatttcagacagtccattagaaataactctaaagaaatacagaatagagctacagcaaaaagaatcatctataccttttattctaagccgaatgaatctagatatatcaaaagctttgcgaagtgatccgaatcaactcagcaaagaacaaactaataagctaaaaaatctaacttctttgtcaaatattagatacggttattaagtagataaacagacgattttctgtggtttggtatatttcattttatttagaaggcattggttaaagaaaaagaggataatcataaccacttttcaaaagggtgacttgctctggggctatgtgtccccaccacgagccagcgtctcaaggcgctggctttccactttgttcaagtcacattggttttagtttgcgattctccgagaccatgaaacagcttgatagtggattgatttctaaaaaactctcgataaattcgtccactttattaacacagatccaatttatatcctataaacatgaaatacgttttatcagaacgtatcagttccaatagctctttccagtgctcttgttgattccttgtatgtttgacaaatattcatctgtagttacctttattattgttggctgttcttcatttgtactaacgctagattctgccgcaaaaacagtttgcggcaggcaagctgagcaatttgatactccaattagggctcttaattagagctcttaatattactttgacaaattttttcaaattgatcacctctgattttttcaaattaatttgaattgttaactctaaatatatcgttaaaatataatagaaatctgcatcacagaatgtcttaagacaacgccatgatgcagatgaatttctcgaaaaaagtaatttaaattacgtaacagtttgatttatcctcctctctagaatacaaatgacattatctatcaagcgaaactactccagaaaaattcatagataatcaaaaaaattgctatggcaaccgttaaaatcaattaacaccgtatcaggttatgctgacaaatctgtccaaaaattcggattaaatttgcaatctaccttatgaataaaataaaaggctagtcactaaccaaaaattggtcagtaactaggcttttattaattagtatgttttagaaatataagttcagtttaattgcgcaacgggggtttaaaaacgtctatataaaaatcccccgggttactaacacgaggaataagttactttaacggtaactgtttaaaaatttattttaaaagaggcagactcatcaagctataggtttgaatgcttatcaatatcaacattataaagctgataggaaggcatcattaaatgctgggatatcctttggttcgcgactggtaattagattaccatcgatcacaacagctttgtcttcaatgcgtgcaccggcataatacaaatcaggttgtacagttaaatatgctgtcattgtacgaccttgcactaacccggtttgaatcattaattgtggaccgtggcaaatacttgctgttaacttattagttgccaaaaagaacttggtaaattcgacaaaccgttggtctgcacgtaattgatctggtgaaaatcctcctgggatgaacaatgcatcaaagtcttgaggactcacttcatcaatggatttatcaatgttaatctgagtaccatgcttaccttcaacagtgcctttttcaaagctgatcgttgtcactttgtgtcctgcagacttaagagcctctacaggttcggtatattcaacgtcttcgactagattagtcaccaaaactgcaactgattttgccataataaaattcctcctttttatgattattcatcgcgttttttatatttagagctagttatttgctagacccactattttttttaagacatacctggtttcaataccactttaatgttattatctgcttttttgtcaaaaatatcgtatgcttcagcagcacgctccaaaggcattgtatgtgtaatgatatccgatgggtcgaactcccctttttcaatcatgtcatagattttcggcatcaagtggataaccggagcttgtcccattttaatattcacattacgagtgaagaaatcttggaacgggaaattcgttgctggagtcatataaaccccagttaccatcaacgtcccaaatttcttcacagcttcacttgctgtttgtattggtgagtaagaaccgctttgcggcgtaagaatatctttagttttttctttgattggcgttacaccatccattcctacacaatcaattactacctcagcaccacccttagtcatttcatataattcactaccaactttagaaacatctgaaaaattcacgatctctacgccgttcatttttttcgcatgctgcaaacgatgatcgacgttatctacggcaattacacgtttagcacctttcattttggcaaatttttgtacaaataatccgatagggccagaacccaatacgattactgtatctcctggtttcataccactatgttctacactccaatatgctgttggcagtacatctgataggaataataccttctcatctggtagatcactatcaggaacaacaaaagaagtgaaatccgcaaatgggacacgtaagtattcagcttgacctccaggataatttccttccattttaccaaaaccgaacaacccgccttgatcaaacattggattagggttggaattgtcacattgactttccatatgattagcacagaaatgacactctccacaaccaatgttgaaagggataacgactcggtcgccttttttcactttcgttactgcagaaccaacttcttctacaatgcccataggctcatgccctaccacatagtcttcttccatgaccggtttcccgttatggtataaatgcaagtcagaaccgcaaatagctgttgctgtgatgcgaacaatcatgtcggttggttcttcaatcgtaggatccgggaccgttttgacttccattttttcgtttccttgccatgttactgcgcgcataaaatcactcctttttgtaaaagcgatatcttcagattatgaagacagcttatcatcctgttttatataagtcaaaagttaaaactttaggactaatcggttatggccatattgcgcaaaaagttgctaaaataggacacgctttttctatgaaaattattttctataatcatcgtcttaaaaaggttcctgaatcatggattcagcaggtttcatttgatgaactagtaaggcaatctgatgtgcttagtctgcatgtgatccaaacaccagaaacaattgatttgattaataatgatacaattgccgaaatgaaaaatggggttattatattgaatacggcccgaggcaaattggttaatgaagcggacatcaagaatgccttgaatgaaggcaaaatttatgcctacgccactgatgttgttaaaggggagcccattgctagtgatagcccattattacaggccaaaaattgttatattaccccacatattgcttggccaccatatgagacaagagatcggttgttgcatatgactgttgataatataaaagcatatttatcaggagatctgaaaaacgttatcaattaatggcaatggtctgtgaattcttttgcctacattgaagtaaaattgtctaaaataaagcaatgagaaaaaacagagccagcaagtaaagtgttaagaagaaattacgtaagttagtaaacaagaacgaaatcgatcaacttcgtgaagaattgacgaaaaagaatcaagaattatatgatgcaaaattggagaacgaaatcttaaaaaaatcaatgaccctgttcggaacctcaaaggacgaaagaaaacacaaatagttgatcagatcagggtcgaacaagagtctcttccgaaatctaaccggtataaagtcggcgatattcttaagaccattggacttaagaaagcgacttatcatgatgaacgtaaacgtatcaaagattatgtagataagtatgaagatgtaaaagtagagatactaaaaattgccgaaagcggaagatatcgcggacgtctaacctacggttatcgtcgcgttcaagaagagctcattaaattagatatccatctatcagacgccgtagtgcgtcatttgatggatgaattaaatgttcaagtaagcctttataaccgccacagaaatggtagatattcatcttataaaggtacagttggaaaagtggcccgtaacgttctacatcagcattttaatgaaaccgtacctttcaaagtattacataccgatgttacacaagtacgcttggccgatactaagtgggcttacgtttcagctattactgacgaagcaagcaaggaagttttagcatttcaagtaagtaatagtcctagcagtaaactaattatggatacactcgatgaactcacagaaaatattccggaaggaataaaaccaataattcattcagatcaaggttggcattatcaattgaattactataccgataaactctctgaaaaaaatttatacaaagcatgtctcgtaagggaaactgtcttgataatgcgccaattgaaagcttctttcatcttcttaaaacagaatgtcttaatggatttccacagtgtaaagatattggagaattcaaggaagtcacaaagaattacgtcgattggtttaacaatcgacgaatatcacagaaaacaaaaggcatgactccctgcgaatacaggggacatgccttagcagtttaaaaatattcaattttgtctaacttttgtgttgcactttaaatgaggtgatgcgcggcaacgtcctatcctcgcaggtagtttcccaccaactactatcggcgctaagaagcttaacttctgtgttcgacatgggaacaggtgtatccttcttgctatcgccaccacactattttgtgcttgcgcactgagaagaacttcgttctctcaaaactgcataataagtaatatttcatttcaaaagcctaacattgcacctttggttaagtcctcgaccgattagtactagtccgctccatacatcgctgtacttccactcctagcctatctacctgatcatctttcaggggtcttacttccataaaggaatgggaaatctcatctcgaggggggcttcacacttagatgctttcagcgtttatcccgtccatacatagctacccagcgatgcgcctggcggcacaactggtacaccagaggtatgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagtccgactttcgtccctgctcgatttgtcaatctcacagtcaagctctcttatacctttacactctacgaatgatttccaaccattctgagagaacctttgagcgcctccgttacactttaggaggcgaccgccccagtcaaactgcccacctgacactgtctcccgccacgctaagtggcgcgggttagagtggtcatacagttagggtagtatcccaccaacgcctccatcgaaactagcgttccgatttctacggctcctacctatcctgtacaaactgtacaaacactcaatatcaagctacagtaaagctccatggggtctttccgtcctgtcgcgggtaacccgcatcttcacgggtattataatttcaccgagtctctcgttgagacagtgcccaaatcattacgcctttcgtgcgggtcggaacttacccgacaaggaatttcgctaccttaggaccgttatagttacggccgccgtttactggggcttcaattctgggcttcgcttacgctaactcatcctcttaaccttccagcaccgggcaggcgtcagcccctatacgtcatctttcgattttgcagagacctgtgtttttgataaacagttgtttgggcctattcactgcggctgacctgacggtcagcaccccttctcccgaagttacggggtcattttgccgagttccttaacgagagttcactcgctcaccttaggatattctcctcgaccacctgtgtcggtttacggtacgggtagtttatttctcactagaagcttttcttggcagtgtaacatcaggaacttcgctacttaatttcgctccccatcacaacttgtccttaaagaatcaagcatttcactcaactcaagacttgttgcttagacacacatttccagtcgtgtgcattccttagcttcctgcgtccctccatcgttcaaacaaaataaactagtacaggaatctcaacctgttggccatcgactacgcctttcggcctcgccttaggtcccgactaaccctgggaggacgagccttccccaggaaaccttagtcatacggtggatcagattctcactgatctttcgctactcatgccggcattctcacttctaagcgctccactagtccttacgatctagcttcatcgcccttagaacgctctcctaccgcggacacttacgtgtccacccacagtttcggtattatgtttagccccggtacattttcggcgcagcggcactcgactagtgagctattacgcactctttaaatggtggctgcttctgagccaacatcctagttgtctgtgcaccgccacatccttttccacttaacataaattttgggaccttaactggtgatctgggctgtttccctttcgactacggatcttatcactcgcagtctgactcccggaactaaatcaatggtattcggagtttatctgaattcagtaacccatgacgggcccctagtccaaacagtgctctacctccatgatccaatattccgaggctagccctaaagctatttcggagagaaccagctatctccaagttcgattggaatttcaccgctacccacacctcatccccgccattttcaactgacgtgggttcggtcctccagtgtgttttaccacaccttcaacctggacatgggtaggtcacttggtttcgggtctacatctatatactcactcgcccatttcagactcgctttcgctacggctccagcttttcactttaacctcgcatataaacgtaactcgccggttcattctacaaaaggcacgccatcactcattaacgagctttgactaattgtaggcacacggtttcaggatctatttcactccccttccggggtgcttttcacctttccctcacggtactggttcactatcggtcactagggagtatttagccttgggagatggtcctcccggattccgacggaatttcacgtgttccgccgtactcaggatccagaacggaggttaagttgtttaatctacgtggttatcacactctttgactcagcttcccagctgattcgattacaacttaacttggtaactccaatgttctgtcctacaaccccaagaagcaagcttcttggtttgggctcttccccgttcgctcgccgctacttagggaatcgatttttctttctcttcctgcaggtacttagatgtttcagttccccgcgtctaccttcattaagctatgtattcacttaatgataatacccgactaaaggtattgggttcccccattcggaaatctccggatcaaagcttacttacagctccccgaagcatatcggtgttagtaccgtccttcatcggctcctagtgccaaggcatccaccgtgcgccctttataacttaacctaactttacctacggtaaagggttattatttgagtttagcgatatgaactaattcatatttctattaaaaaactctttaaaacgcaatgttttctcggcttttaaaactaatatattacttattatccagttttcaaagaacaaagtttgaaataagcgatcggaagtaataataattaccagaattaaaagatagagattattaaaaatagtgtatttaagtcgggtcatagtaaccgcctttttcaatgagtgtaccttgtcttgcactaaatgacaatttaatccataatccaaaataatcaagcatttttggggatttaatgggatactaaacgggaggttcgatggtaatcgctattaactttttctttttctctcacgtttctaatgaacagcgcttactttacaacatttgtgaactttttaagttttaatcttgatttccggggtgaaaatgcctaaactttaaatagatactaacataaattttttggaggctgacatgtctgaacaatatttcgaccctaagttgaaaatctttgctttgaactctaataagcccttagctgagaaaatcgcggctgaagttggggttcctttaggaaaatcttctgttaaacgttttagtgatggtgaaatccagattaatattgaagaaagtattcgtggcgacgaaattttcattattcaatcaacatctgcaccagttaatgataacttgatggaaattatgattatgattgatgcattgcgtcgtgcatctgctaaaacaatcaatgttgtgttaccttattacggttacgcacgtcaagatcgtaaggctcgctcacgtgaaccgattaccgctaaattagtggctaatatgttaacgatggcaggggctaaccgaattttagcattagacttacatgccgtacaaatccaagggttcttcgatattccagtggatcacttgatgggtgctcctttattggctgattatttcttgagcaatgacttggctgaaaatgctgttgttgtttcacccgatcacggtggggttacacgtgctcgtaaattagctgatttcttaaagacaccaatcgcaattatcgacaaacgtcgcccaagaccgaatgtttctgaagtgatgaatattatcgggaatgttaacggtaaacgcgcaatcatcattgatgatatgattgatactgccggcacaattacgttagctgcgcaagcattgaaagatgctggtgcaacagaagtattcgcatgttgtacacatccagtattgtctggcccagctattcaacgaatcgaagattcagtgattaagcaaatgattgttacagattcaattaaccttccaaaagaaaaattaatcgataaaatggtacaagtttctgtcgggccacttattggggacgccatcaaacgaatccatgaaaacaaaccagtcagtccattatttgaaaacagatttaaaagataagcgtgctaactcgaatgggttagctttgaggaagcacatttcaataagctaacaattaaaaacgcctgaacaatttgttcaggcgttttttgtgactttatttttctttgttagctaataaatcgcgaatttcttttaagtaaacttcttctttcgtttcgactacttgtgcttcttcttcttcggtcttcttgcccatgtcacgaagcttgttgaatcctttgacgattaagaagacaacaaatgcgatgattaagaagttaatcacatcgtttaggaagttcccgattttgaaaacagccttggtgcctggaatggtaagcgcaataccggatagatcaacttgtccaacgaataatgaaatgattggattgattaagttctttgttaatgagtccacgatgctttttaaagcagcccccaaaataaccccgacagccatatctagcacattaccacgcataataaattctttaaattctttaatcatgaaaacgacctccattaatattattaattattgctacaaaaagtataccgtatttccagagcctataaaataaaaatgctgtgctagttacataattaaccaataaatttgttattttcatgaaaaatcgttaagatagtcacaggaattaaataacagaaattagagatagaggaaccttagatgaattggattgtacaattgtatcaaccattctttgaactgagtaattggcaaactgtcattacgtcgtccgaagattggcttttaattttaacgttagtgattatggaatgcttactctcagtagacaatgctgttgtattagcggcacagacacaaacattacctacaaaaattgagcaagaaaagtcattggtgtatggcttatggggcgcttatgttttccgcttcattattattggtgtcggcacctatttaattcatttgtgggaaattaaagttgccggttcattgtatttaatttacttagtcattgcttatttcagaaagagtgggcatccgaagcaggctaaaacaccggaggcgggttctaaaatcagtagtccgcatcggttctggcgcacagttgcttcgattgaattgatggacattgttttttcaattgattccgtattagcgtctttagcgatttctagtaatccggtgattgttttaattgggggaatgattgggattatctgcatgcgggggattgcccaactcatcgcccaattgatgaagaaaattccggaattaaatccgatggcttacatcttaattctcttcatcgcgattaaattattcttgtcgattccagccattgactatgaaattcctaacctagtgtttgctggaattgtgtttggcgttattctactgacgctcatcattcattatgtccgtgcagcacgggctaaataggcatcataaaaaaagccgttgtgatatgataacttatttttaatttatgctatatatcataaattaaaaatttagagaccattctcttgattaaatgtgtaaaacgatcacacatatattggttcgattagtcgagtaattcccaaatattaaaagaatattttgaatcaatataaaattagctggttttcaaaacctgtttaaaacttgctcactttattaacttcaatctagatggttcatgttgatcattgtgacaaagggttcctgaagttctcttattttttaacctatttttgatcatatgcttcttggaataattgaacgatttcttctttggttcctttacgaggatttgaaaaagcgttaccgtctttaagcgcattctcagccatcaattcaaagtcttccggtttagcaccaattgctttaatgcttcgagggatcttgacatcatcacacatttggcgcattgctttgatggataagtcggcagcatcccttgtggataatccgtccgtattttcacccataattttagctaattgtgcaaatctttccggtgcggcaacaatattatacttttcaacaattggaagtaacattgcacagcaaacaccgtgtggcgcatcatattgaccgcccaattgatgggccattgcatgaacatatcccaaatcagcattattaaaagccataccacccaacatttcagcttcaaccattttggtgcgggcttcaatgttgtgaccattagcaacagcttcacgaagactttcttcaaccaatttaattgcttgaatgcattgaccatccgtaatttcatttcggttggttgaaacataaggttcaattgcctgaacaaatgtatccatccctgttgcagccgtcaatgatgccggaacatccaacattaacattggatcattaaatgataccaatggaatatttcgccatgacacaacaacaaatttcaatttagttttttcatttgtgatcacacaatgacgggtcagctccgaaccggtcccggcggttgtattaacagccatcaatggtggcaatggattttgcagcgtttcgattccggcaagcttggtgatgtcatcaccgtttgtcaaaatgataccggtcccttttccggcatcatgtgaagaaccaccaccaacagtgataatactgtcacaatcattatctaaataaactttctttgcttcttgaatatttcgaatttttggattaggttcaacaccatcatagatggtataaggaacgccaactgcttcaagtgacgctaatgtttgagcaaccggtccattgtccattgaccgcaaaaacttgtcagtcacaatcaatggctttttcatatttaacatttttgcacgatcgccaattttcttgataacccctttaccaaagaagttgacactcggcattaagaaatcaaagttttctttcattgtaaaagcttcctcctagatggttatagtttgaatcaatttcataatagcattttcatacaataatgcaaactatttcacaatctttttaatgttaatcctatctcaaggctattttaaagtatagggcccttagaaactgtccaatatctatatatttttgctataatctagtgacaactttttgagctttttattgaactagtcatagttagccagtagaattatccaaaaagcaaagttgttcaatctaactaatttgggtattggctaagggtatcaggaattaattcaatcttcttggcttatctacatcatctatgaccgtcacttttaattagaagtagttttttgttaacgttggaattataattgttctctgactcttttaaattataattaacatttgtaatttattacacaatacgcatttaaataaagatagtaacaggcctctcaatgatcattgagaggcctgtttgtgtcaaagtacctactgaagcagggatcgtatattaattaaagaaagtgcttttactaccacaactattagaaagtagctcaattggtttgataatcaacatggcgaatggcggccaatggaataaattgcgcttcatcaccaataatattatcttcttgataacctaagatatgagttgttatttccagtcggtggggatcctcaagctggcatacatttaattgaagggtgacgattaaatctcgttgataggctggatgtaagctgattcctgagacaacttttaagagagggtataatgaataaatcatctctcaaaaggaaggaatttttacatggtataatttttcaagaattaaaacaaaactgggttgtaaaagtccgattgaatatcgaatttttacaacccagaaagctacttaaagtttcgtccaatatttggggttcacttcaactacatattttttattaaaaataatacttttttatttctttttgggtgcatatcttgtatgctaactattagttaacgcctttgtattttatgtcatactggggtatgattaacctatgcagagattggagttgaggttgtgaaacttacgaagaaagcctacgtcgcccttggcgtagcagccgttatccttgttggaggttactcggcagtcagtcttcattatcaaaaagcattcttgccacatacgaccgttgccggtgtcaacattagtggccaatcagtcgcagacgctaacacagaactcttaaaaaaagtgaatcgtcaaaaatatacgctaaaggataacaatcaaacattgctaacttttagcggtcaagaagctggctttagccataattttaaaccgttattggaaaagattgaaaaaagccaaaacggttggtcttggctaggccacgtttttgccagtgaacaaacaactaaatcagaagacgcactcattttaaatgccgctgattttgacaaattctcaacggaaaccctcgaaaaggtcaacgctgatcgcaaaccttcagagaatgcccatattaacctcgagaatcatcagttcaatctcgtaaaagaagtctacgggaacacaattgatgccgctaagttcaaaaaagcagttgcccacggtattaaccaaggtcaagcaacaatcgacttaaaaaacgattatgcgcaacctgaagtgaaatctacggacaagcaattgaaaaaaactgccgatcaattgaagacgattgctaatgaaaaaatcagctattcagttaatggtaatgatttccaagttcctaaagaagacatccaaagttggttaacgtataacaacggtacaattagtctagataaagctgccgttaccaaatacgtttatcaattaaaggcaaagtatgatacttttgacaaagatttgaccttcaattctacaaaagaaggcacagtcgctgtcccagctggaatttatgggtggagtatctctcctgccgatgaaatccacgccttaatgacagaagtgcctaagggcaaagatttctcaagaacagctgttatccgtggttccggaactgatcagaaaacgcgtagtgtcggttcaacctacatcgaaattgatttaaaagcccaacatatgtggctctatcaagatggtaaggtcacaattgacactgatatcgtttcagcacgtccaccacaagtcaccccaaccggtgtttggagcgtttggaagaaagaacgcaatgccacattgaaggggaagaactttgatggggtcagcgaatacgcaagcccagttaattactggatgccaatcgatgaaactggcgttgggattcatgattcgccatggcaacctaagtacggtggtgactggtataaagaacacggctcacacggctgtatcaataccccacctggcacaatggctaaactctacgatactgttagcgaaggcattccagttgtagtgatttagacgtagtgtactagcaacacctctcctctacggattaaccagaggtagctgacctacagaattcgtttagaaaaagtaagctcaacgattaaatacaaagtaggaataaaattaacttttatccctgcttttttattgcttagatttcacgttctttctcatcgattactaatcaagttttcgctgagtcgaaaaactagttattttaatctgcttggtggtatgctatgattacattagtatatgagagaattttaatctaaggagaaagcctatgctcattaaatccctagttttacctaaagaacgtctcaccacaattgttgaatcggtgaccttagaagaagcattacagctactagaagagtctggttaccgttgtgtgcccgtcctagatgctagcggcaagattttccgcggtaacatctataagatgcacatctaccgtcataagtctcaagggggcgatatgcagcttcccgtgaccagcttattgaagaatatgaccaagtatattccagttgacgcaccgtttttcaaagtattcttcaacattaagggtcaatataaaaacccccgatattggattttggtccaatatcgggggttcacttcattaggactttttgtcttaacgctgttttttttgtgactttaaggggcctttttgaattcgcattttaagcaagtttcgcgaccacttgtccactcactaatctgaaacgtccttaaaatgcgcctctgtgattgatcgtttataaacgtgattagaccgtgatttagccatcaatagcctttaatgtgtttgagcgcattctttggtagaaaagaatgcgctcggaatccctttaaatcaacgataatcaaaggtgcaaaataccaccgcatggtttataatgatatagagaaaaagaatgcggtcaaaaaggcggaaaaaacatgcggaaatcgcgcactaaaaaaggcaaaaaattaaatgttcaacctttacggacaaaagatgagattgaagacatgaaagtcatcttgcgccattcacaaatgggtagtcgcaattatttattatttttactcggcattaatactggcttgcgctgttctgatattgtgcagttaaaagtcaaagatgtgatcgaagacaatcccgtgattgttgaacaaaaaacgggtaagtggcgccaaattagtttggcgagtttacgcccatacatcagtccctatattcaaaataatgaattgctaggcaatgattggttgtttcctagccgcgtcggcgataaccacatcaccgtcaacggtgtttaccgcatgttgactgaagcaggtaagaaacttgggcgtaatgatattggcacccatacgatgcgcaaaacttacggctactggttctacaaacaattcggggacgtgcggtcattgatgattgattttggtcattcaacgcaagaaacgacgctccattatattgggattacccaagatgaagtgttaagcaagaaacaacaactggcgattggactttaaaaaaagcttgcattaaagtgaggtctaaggtgtatagtaaagacaatataataggaagagataggagattatagttatgaaaacagctacttttatgggtcctggtcaaatgaccattaccgaagcaccaaaaccaacgattgaaaagccaaccgatgcggtcgtgcgcattatccgcgcgtgcgtctgtggttctgatttatggtggtatcgtgggatttcaaaacgagaagtaggcggtttcaccggtcacgaagcaattggcatcgttgatgctgttgggactgacgtacaaaatgttagtgtcggtgattttgtgatcgtgccatttacccatggttgtggccactgtgccgcttgtttaaacggttttgatggcgattgtaccaaccgcgagaataatcctggtggctaccaagccgaatatctccgttatcacaatgcaaactggggcctcgttaaagttcctggccaaccaagcgattactctgatgaaatgctgaataatctattgacgctttcagacgtcatggcaaccggctatcacgctgccgtgtctgctgaagtgaaacccggtgacacagtcgttgtcatgggtgatggcgccgttggtttatgtggtgtgattggcgtcaaattactcggtgcgaaacggattatcgcgatgagtcgtcatgcggaccggcaaaaattagcccttgaattcggcgcaacagacattgttgctgaacgcggtgacgaaggggtcgcaaaagtgatggcgttaaccgacaacgctggggccaacgccgtcttagaatgtgtcgggaccgaacaatccgtcgccactgccgtcgccgttgctggcgcaggggctgtcattggtcgtgtcggcattccccaaaaagcagagatgaacaccaatgccttattccggaagaacatcggtttgcgtgggggaattgctgccgtaacgactcatgatcgcgctcgtttattggatgctgttttaaagggtgccattaatcctggtaaagtctttacacaacgctttaccttagatgatattcaagccgcttatgaagcaatggatcaacgcaaagcgattaaatcattattaatcatcgctgaataatataaaaagtgccgcagaacaggaaaaatcctgattctgtggcacttttttaatgcccttaatatgaatggataaatatagtatagcaaattaacaagaaaacggttcaaagtttagtcggaatcccttgtttttttggtctataccatttatactagaggtaatttaaagatagaggtggatggacaatggcagtaaaagtattaaaacatgcggtaatctatacaggtgacgacgttatcgaagacggttatattcgtttcgatgataaaattttggcagtgggccccatgttcgactacaaggcacaagctggtgaagaaattcaagatgttaaaggcaagacaatcattcctggctttattgacgttcactgtcacggtggttatggttttgatgcaatggacggcgatgctgaccaaatcgacgaaatggcaactaagatgatgcaaaatgaaggggtcacaaccttatttgcaacaacgatgacgcaatcaaacgaaaacattgctaatgctatgcgcggtgttaaagcagcggctgaaaagaacccattaattcaaggtgttcatttggaaggcccattcatcgcaccaatcttcaagggtgctcaaccagaacaattcattaaagatccagacgttgacttattggacgaatggaatcaattatcaggtaatcgggtgcgtttaattacttatgcaccagaagatcctggttcaaaagcattcgaagactactgcttagcacacaacatcgtgccttcagttggtcatagtaatgcaacgcgtgaacaaatgcttgaaagtaaagcaacgcacgttacccatttatacaatgcccaacgtgaattcaagcaccgcgaacctggtgttacaggtcacgcaatgttagaagacaacatgtacgctgaattaatcgctgatggtttccatatcgtgcctgacatgattaaattagcttacgaacaaaaaggtgcagaacggatcgaccttgtgactgattcaatgcgggctaaagggattgctgaaggcgaaagtgaattaggcggccaaaaagtcattgttaaagacaaacaagctcgcttagaagatggcactttagccggatcagtgttaacatatatcgatgccttcaagaacatccaaacattcacaggttgtgaaacgtttgaagccgttatgatgtcaagtgtcaaccaagccgaagaatttggcttaacacaaaaaggtaaattagaagaaggtcgggatgctgatttcaacatcttagatcatcaacaaaacttagtcgcaacttacagctttgggaacggctatcaacattaatatttaggagtgtgtcccatggaatcacctgtttatattcaaattcataatcaactcaaaaaggatattgaagccggcaagtggtcgattggagatcgaattccttcagaacgggagcttgctttaaatttcgaagtgtcgcgaatgacgttaagacaagccgttcaaacattggtcgacgaaggaattttggaacgccgcattggggccgggacatatgtcgctaaccaaaaggtgcaagagaaaatgtccggcgtcactagttttaccgatctaatgactgcccaaggcaagacgccatctagcaagacgatttcttttcacattgctaacccatcattaagtgaagctgaaaagctccaactaaaagacggtgaacaagtgctacggatggaacggattcgttacgccgacaatgttccgatttgttttgaagtggccacagtgccacaaccattagtcgctgatttcagtaaagctgaaatcaccagctctttttacaagacgctggaagaaaaaggcggctaccaaatgggtggcgcgcaacaaaccgtttcggctcaactcgcctcagaacgcattgccgaatacttggacatcaagcgtaacggctcaatcttacgcttgcgccaagtatccttcttaaacgatggcacaccatttgaatacgtccgcacacaatacgtcggcgaacgatttgaattttatttggaaagataaaaaaagagtcaaaacaatgagtttattcgttgttttgactcttttttgattaaccataaatatgatctgttgtgatataatgtcaatcaaacttgtcgctgtcgatatggacggcaccctattaaatgaaaataacatccttagccctaaaacaatcaaagttgtcaaagctgctaaaaaacatagcgttaaagttgtgctatgtactgggcgaccactcaccggggtcacgccttttctaaaagaactgggtttaactgaagccactgactatgtgattacgttcaacggtgctttggttcaaaatacggcaactggtgaaattctagtgcgtcacactcttacgcatgaccaatatcttgaacttgaaaccctctcccgccaaatcggttctcatttacacgctgaagatgatcaattcatctacaccgccaatcgcgatatcagcccttacacagtcggtgaaagtgccctcgtcaacatgcctattcgtttccgccatgtcgatgaaatcacacttaacaaggccttttcaaaagtgatgttaatcgacgaacccgccgtcttagctgaagccaaaaccaagattcctgctgattttttcgatcgttatcaatttgttcaaagtgaagcctactttctcgaagtactcaacaagaacgccggtaaaggaaatggtttgcgcgatttagcaaatgccttaaatattgatcaatctgaagtaatggccattggtgatcaaggtaacgatctatcaatgctagaatacgccggcttcccagttgccatggataatgccattcctgaattgaaaaaaattgctaaggttgttactaagagtaaccatgaaggccaagatggcgtggcatacgccattgaaacatacgcctttgaaagccaagcctaatcataaggggagttattatgactacgttaattgatctcgtttacgcgtcaccccttttctttttgattttattcattggtttacagcgatttgaaaaacgccaattaatcaacggcattgtgtttaactttttcctcttcagcgcattaatggatgctgcgctcattgtgattcgcctcaataacgaaacgctgaataacattgcaattgctgctgcaattgttgtcgttctaatcgtcatgttcttctacttattcggtattgtcttgttgctgtggaacgcgtatattgtctggaaaaaagaaagtcacacgttatccaacatgctgaccctcctcattgcgttagccatcattggctcatttttcatcccaatcatcacgcgcttgttacacattcccgccgatgttaaattatttgtcagcataattgtatcggtttttcttttgtatattccattgttcttctatttatatctaacttcactgattatctatcaattcaaccgcccccgttatcaacaagattacatcatcgtcttgggtagcggtttaatcgatggtcaattcgtcccaccgttactggccagtcggattaatcgcgccattcgattttatgataaacaagtcaaaaaaggccgtcctgcaccaaaactggtcttttctggcggccaaggtccggatgagaagctgcctgaatcagttgccatgcaacgttacgccattgagcaagggattccgattaaagacaccctcaccgaggaaaaatcagtcaacactttacaaaacatgcaattttcaaaagacattatcatggctgataccactaaatcgaatcctaaaattatttttgcaaccaataattaccacacattccgcgctgggctttttgcaaagcaagcccgtttgaaagcagatggcattggcgctaaaacatcgcgttacttcttaccaaatgcaatcatccgtgaattcattgcaattctcaaaatgaaacagcatcaattcattttagtcgcaattgcaagtgtcgcatttgcagccttaactgttttactcaatcatatgtaacgtaaaaagccgttgtggacaaattgtccacgttgttttcaaacttcattttctttgaggtatacaacttttgtgaattgccatcaaattctttacttagataaacattcaacaaatgatctgaaagaatccatgattccttaccaggtaaagcaaagacccctttaatgcctaattgttctttttgttcatttaatgttttaacagctgcttctaatttatcgtaagtcgttaagctctttggatcgataccggctttttcgaagaccgctttattataaacaaaaccatagccttcaatgttaaatggcaagccgtaaactttcccttgtgacttaacagtatctagtgtgcttggaatagcggccttagcagcttttgtatccgttaaatcagccgtgtagttcttgaattgtttaaccgatgctggcccatctaaactaaaaatagtaggtgcattcccggatgaaattctcgtcttcaaaacgggattatactgtgtcccaccaccgattgatgtgatttcaatcttgacgtttggatgtgctttttcatacttctttgcaatcgctttgaattgcttgttggattccacttttccttgtagaattgtgattttcacattgccgccatccgcactcttgctcccacaagcagccaatgttaacgttacaccagccaataacgaaactaaccctagctttttccacatctttttcactataacgacctccaataaatttttatcagtgctgtttacaagttttattgtcgtactttgaaagcgcttttgcaaatgttttcctgatgttaccggtaacagttttcttatgcttattccgattgttcttttagcacagggcgaattgtcccgcccatttcaatgtttggttcgaatatcaatggtcgctcaatccactcctgattaattttcttgaggatattctctccgcatgcacggcccatttcaatgatggactgcttaatcgttgtcaacttaggagaggcaacttgatttaaaaagaccccatcaaatcctgtaatcccaaactcttgcggcacatgaccaccacacgacgcaatcccccgttcaatcccaattgccagacgatccgtggcacaaataaacgcagtctcgagtttgaattgcgcccagtgttcaatgatgtaggcttcggtcaaatgactatggttgttaaaatggtgtaactgaacaggacgctgctgctcatgcattaattgtaaataaccggcttcacgtgatttttcaaacgcttcttcactcgccattccaatataaataagctggcgataaccacgctctaatgctaattgcgctgcaaggtagatccccaactggttatttgtatccacataatcaaaaccgtactgattctccccaaaaacgacgactggctttgtcagatcgcgaatccatgcaacatcactttcacgcaatcccgtaataatgtagccatcacaattcccgatatcaaagttacgccgagttactaactgcagcgaatactgatgtaggtcaagtgccttagcaattccgaccattagattcatgtaatatggttcggtaacgtcgatgtcttccaagatacacaatttgatgattcgggtactgttgctgactagggctttggcaattaaattgggacggtaatccaattccttcattgcggcatacaccaattccttcaattcatctgttacttgttccggatgattaatcacccgcgaaactgtcatcttagaaacgtttgcccgcttagcgacgtccattaatgttgccatttctccaccccttaagttcaactttttatattctttcacaattataccaatttatgcataaaatgattacgatttaccttattggtattaaaaaagcccatcatctaaagatgatgggctacggttattttttttgattaaatttcagaatctcaatgactaacatggcaaccgaaattgccaacatcagtgcgttgaaaaccgacatgttatcctttctcaaggtaacgcttaatcaacataggcatcacctcatttctgagcgttagccaccgtcataaacttactgttaggattactgtaacatagtttgaatggttaacgactagggattataaagttctttaaaacaaaaggcaggcgaaatcattttgtgatttcgtctgccttttttaattagtgctcagttgctgaccgcaattaagggcactcttattgaaacgtgctgtttcaaactgccttttccggttaaccaaaaaacgcgaatcatgacgaaaagcgtcataatccgcgtttttaagttaatcctcaaagccaacccgtttgaatcagcactcttagaatgtttgtagttcttttgtcatgtgtgtgaaggcttctgatcctgtttctgttacgtggacacagtcttcaattcgaacaccggcaacgcctgggatgtagattcctggttcgattgagaaacacatgcctggcttgataatcatgtcgttgccttccatgattgatgggaattcgtgttctgaagttccaatgccgtgacctagacggtggatgaagtattcgccgtagcccgctttagtgatgacgtcacgtgcaatcttatctaattcagccgctgtgataccgggtttgattgctgcttgggcagttaagtttgcttcaagacagactttgtggatttcgagtgatttcgcatcgggtttgccaaaagcaacggtccgcgtcgcatcactcatgtaacccttatgcaatgtcccaaggtcaaagagcacgagggcatctggggttaaaatgttggcttcggggccaccatgggggttagctgcgttgatacctgattgtacgatggtatcaaaactcatatgcataacgcctttgcgcattaatgcgtattcgatttctgcaacgatatcttgttctgttttacctgcttttaaggcattgaaaccaacttcgaaagcataatcggcttcacggccggctgcttccattaaagcgatttcttcaggtgttttaattaattttaagttttccatgaaacgtgaagcgtcgcctgggaatgttgcgtctgggaattgctttagaatggcttcgtaacgttgaacaggaaggtcgtctttttcaagtgcccaacgtgtagggttcgcattccgtttcttgatttgatctgcgatgattgcgtatggatcttcgtgatcgagatagccgtaaacgtcgagtttccagccagcttttttagcagattcaacttctaattgtggtgtaaataggaatgggtcctgatctgcaaaaacaaagagggctaagacccgttctgcaggatcactttcgaaaccagtgaaatagaggatgttggttggattactgatgtaagccacatccatattattctcaccaagccaattttctaattgggctaattgattattcatctaaagcacttcctttacaattgatatcactagtatatcacaaccaatgtaaacggtaatgtaaaccacaaatgaaaacaaaaatgtaaatttcatgaaaattagtgtaaaccgcttgcatttgctttaaatctctgttaaattaatcaagaagtaaaatgaaaactgctgaaaatataatctattttattttacaaatgaaaggaattctagtggtaataagtcaagaagataattgatataaatatcgtgtaattttacaaaattggcaacactaaactaagcctacttaaaattcataaaaattttagtaggtattccaaagatttgcgtgaataactacgttattccttcaacacactctttggtggtgtgtaaagttggtgattgcgtagtagcgcatcaaccaaacgcacaaattttctggcggttaaaacaatagctcggcggtgcttatttatcggggtttcagtatatttctttttataaaaagctgtgtattcaggtaagtgattttttaccgagttggcggcttcaactaagtaataacgtaaataatgattaccttgttttgttagtggtgtgacttctgactgataatttccagattgtttaactttccaggatagaccggcatatttggcgacttttgcttgatcatcaaatcgttcgatttgaccgacttcagctaagatacctgcggcataaaccttaccgattcctggcacactggttaagcattgatattcaggaattatttcaactagtttttcgatacctttatcaatttgtttaatactttgctgtaatgaacgcatttgaactaccaaggtactgagaataatatcaatcgactcattcattaatcgcggcaactgatagctatttttaatggcacgctgaatggttttaaccagtttttcaggatttttaaagttactgcggccaacattttgaatcaattggacgaagtcctctagtggtaaattggctaattcatctaatgagtagttttcagtcattaaatgtacaattgtggcgctaaaaatgccggtagattctgattttaattccttactaagcgtattacatttataagttaagttttctaagaaatgttgtttaaccgttactaattcggtaactagttgatatctagtacgggttaaacgttgaagtgccatatatttttcttctttgataggtgacgttgtaaaacgttgaattcgtaagtagtcagcaattcgcatggcatcattggtatcagttttgtcttcatcgaagacacgagaatattgcttgattttaaatgggttttcaacagtgactaccgttggtagtgcatttaagtctgcatcttcttggaaaaacatagctggatgaaaactatatagtgatgttgattccataccaatcacaatctgttcaaatgatacttctgcgtgatgttttaaaattaaggctttaatttcagaagcaccatttaaatcgttagcaacacttaaacgatttaggattgataagttactatcatcagtcataaaacaagcatcaatcttttcagaactaatatctaaaccaacaaataatttcacaggaaggacctcctttcgagagttatttggaacttgctttgatactgcgggattccccagaaaatctttacacagctacaacctcgcgtaacagaattttgaccaattggacttatgccgccttcaaactactacattgaagataagcctgattgaaaacagctagtgagttgggagagagcgtaaagactcgggtaacggacttactaaagtagagttaactacaggagtttttagcaaattcccgatagatccattccatggtcctattatattctgaagaatcccgcagtatcaaagtaataattaaattttattgtaagccaacggcttataaatatatcttacgagaacaaaacaagagctacaaacttttaatcgagagtttgatcctggctcaggacgaacgctggcggcgtgcctaatacatgcaagtcgaacgcactctcgttagattgaagaagcttgcttctgattgataacatttgagtgagtggcggacgggtgagtaacacgtgggtaacctgccctaaagtgggggataacatttggaaacagatgctaataccgcataaaacctagcaccgcatggtgcaaggttgaaagatggtttcggctatcactttaggatggacccgcggtgcattagttagttggtgaggtaaaggctcaccaagaccgtgatgcatagccgacctgagagggtaatcggccacactgggactgagacacggcccagactcctacgggaggcagcagtagggaatcttccacaatggacgaaagtctgatggagcaacgccgcgtgagtgaagaaggttttcggatcgtaaaactctgttgttggagaagaacgtatttgatagtaactgatcaggtagtgacggtatccaaccagaaagccacggctaactacgtgccagcagccgcggtaatacgtaggtggcaagcgttgtccggatttattgggcgtaaagcgagcgcaggcggtttcttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggatggtacaacgagtcgcgagaccgcgaggtttagctaatctcttaaaaccattctcagttcggattgtaggctgcaactcgcctacatgaagccggaatcgctagtaatcgcggatcagcatgccgcggtgaatacgttcccgggccttgtacacaccgcccgtcacaccatgagagtttgtaacacccaaagccggtgaggtaaccttcgggagccagccgtctaaggtgggacagatgattagggtgaagtcgtaacaaggtagccgtaggagaacctgcggctggatcacctcctttctaaggaataatacggaaaaccttgtacatttgcgaagtcgaaactttgtttagttttgagaggtctactctctgccatttattgacataggagcagaatgctgggctattgaatagaaaccagttaaggcggtggtgtataggttctttttggacgcttaaaaaatgaactgttttatatggagtattctggaaggatattagtatagacccagtgagcagtgtttttgacactgaattgtttaaatagtacgtttgtattagtagaaatataacaaataggagatgaaataatgaaacaagtaccagaaacaaaaatcaaactaacggatgtaaaggagttgattaataaagggtataaccttttaggtgagcttcgtgaagaagcagatgctccagtagcaaaagcagaatttctaacagaagaaattacaaccgtttatggagaagaagcagcgcgtaaattttataatcctgaaaacttcaagcgggaagggtctatgccaaaagtagtattgaaaactttatttggtgaagacggcgtacagacgatagatggaaagaaacaccatcaacgtaaaaattatttcatggatttgatgactccagaacgtatggaagactatagagctattctagatcaaaatcttgcgaccgaactcgatcagcaacatggcacttttgagttattcgacctttctaaaagagttctctttaactctatttgtgaatgggctggaattaatctagcacagtatgatccgaaagaaatcgataagcttgctagtaatcaaatatccatgattagcggagccatcacttctccaacggaccacttaaaaggagtaaaagaccgtaacgaatcagagggatgggctcaatcattaattaaagaagctcgcaaaaatcctgtaccaggcaaagaaaatcttgccctctatacattcgcacaagcagaagacctagaaggagagttattaccagtagaggttgcagcagttgaattgctaaacatcattcgtcctactgtagcactgacggtttggatggccttaatggggcatgcacttttcagtaaaacgaacttgtatgaccaattaaaagaagactttgataccctacaagattcctttattcaagaaatgcgtcgctactatccattctttcccatgttaccagcaatcgctcttcgtgatgtagaaattgatggttacgaaataccaaaagatagctgggttgtcttagatatttatggtacaaaccatgacgctcgtacgattgatcatccagaaaaattggatatcaaaagatatattggaaaaacaaaagaaatttcttatgaagaagaatacgaaatgattgcgcaaggtggaggagaatttagaaatatgcaccgttgtgcaggagaatggattactcttcacagtatgcgtgtcttttctgaccaattagtaaataaatataactttagtattcccgaacaagactggaccgttccaatgaaccaatttcctacgtatccaaatagtaaagcattgttgtttaaagaatgatttaaaaataaaagtttggtagagagctcccgataaaatggtacccatgtcaaggacacaataaaaaaagagattaagctgcttgaagatgcctcctatattgaataggggttctaaactttgacgagtcacggttattttttaccaaaaacttgccaccgtcttaagcggactgtggagaagagtcgtgttgtcgcacggctctttttctatgttttcattataacaccgacttttaaaatttgcactagtcgtcaattcaaacaagcaaaaaagcccccgctaaatcaggcttggcgggggctttttcattgattatttatcttcagtgacttcttcttgaacagtttcaacagcggcggctgcttcgtctttggcttggccaaatgcactcttgccgtcgatcacgatatcgtcgaaatcttcttggctagcttcaaggctgccgccaaattgtgatttcaagtctgctgttttttcatcaaattgtgcttttgcttgttctttgatatcagacgcattgtcttgccaatcacttgcataatcatggacgcgattcatgtgtagctttgcgtcgtcttttaagtctgctgctgtttcacttgctaaatagtagtagtcttgtgcgcgatccattaaatcatcacctaagtccactaattttgattgtaattccttacccgtcttaggagttaacattaatgttgcaccaatggctgctgcgccaccgactaatacacctaatagaaaatgtcctttttttgccatgagaattactccttatcctttgtttgacgtcgattttgataaaatcttaatgcacttgcgccaaccttcgaagcgaccgttgccttagcggttgtccgcccaacgttggtaacatgttccgttaaattgcgacttgccgtattcaaacttgaaacgctctcgccaagttcgccagccgctctgaaaacaggatccaagtcagcgactttcccgttcacatcgtctagcaatacgttggctttgctgagtaaaccttctacttctttagataaaatatcaacattctcagtaacaaccgtgacactcttgttggcttccgttactgtcttagaaacatccgttaatacttttgtgacttttaatagcatcactattagaaaaacaactaggaccgcaaaagcccctgcggcgattagcgccgcaatttgaccacccgtcattgatttgttcctcctacttcgttatctattacattgcctcttaaagactagaatagcattatttcccttaaccttcaattatcttcactatattaggtgccattttttctgacatttgctaaactaaagacatgctacaaaaaagtgccggatttaaaattgaagtgcaacacctaaatgactagaccaaaaaggccatgaagacctattcttatagttaccacaacaaataagaaaagagatgtcttcatgacccttaaccagaataccatgattagtaattaccaacaacttcaaccttatgaacgtggcttgatcatggctcgtaaatctgacggttggtcttgccgtcagattgcgcgtgaacttcatcggagtccaagtaccatcagtcgggaattaaagcacggtacaattcgtcaaattggccctaatcacaagccctttgaagcttactttgcagagactgctcaaactattcatgcaaatcatcaagctaattctcatgccgttagctggctggtcaaggcacctgtgttcttccaacaactggtcattgaacttcgtcgcaagcctagagtccacagtattgatagctttgtgcattggttcaaactgaaccatcaagaactagcttgtccgtcaacaccaactgtctacagatacattgataatggccttttagaactaactaatagtgaactacccatgaagctacgtcgacgggtgagatctgttcgtaaagctcatcagcgtatgaataaacgtaccttaggcaagtctattgaagaacgaccatttggagccaataaccgaactgaaatcggccattgggaaggtgatctagttaaaggcaaacgagttgccagtgaacccgctattatgaccttgactgaacgtgttagtcgttatgaaatcatcgttaagattacggactatcacgccgacacttgtcaacaagccctgcaagatgttatcgatgactatggtccagaatactttaagacagttacttttgacaacggttcagagtttgccgatttatcaaaggtagccggcacgacagtctactttgcccatccatattcaccatgggaacgtggtactaatgagaaccagaaccaactgatccgcgagttcattcctaagggacattcaatgagagccttgaccttaacagggattcaagcaatccaaaacgctctgaaccaaagaccacgaaaggttctcaactatcaatcggcaatggcagttctgccagacttcgattaactagaccaataactaagaataggtcgaaagtgttgcacttgatttgacaattcgggcatctttttctaaacactcgttctaattctgtcggaattaaaccaactgatgtaatttgaggttcggattaccaagtcctcaaaattggaaaaagttgtttgaaaggcaaactctctcttcaacaatgagtgaaaagcttcaattggcccattatcataaggataaccttgttttgagtatgagtggctaatctgatgccgttcaagtaaagtttcaacttcgttgctggtgtactgtgaacccatgtcagagtgaaaatattgtggcttttgatgatattcaagcgcctgattaatcgtttctacaactaacgtcgcctccatctgacgaccaatcttgaaagcaagaacttgatgaacctttggttcgtaaatagaactgagataaacccaggttcctggacgtaattccaaataagtaatgtcagcacgccatatccttgcattgggctggtgcttgattaaattggggcgttgtgaatgatccacatgagtgccaggttttttaaatcgccgattcattaaagagtgaatctccatttccctcattaatcgtaaaattcgttttgacccaacacagatgcctgacttgcgaagcaccatcgttattcgtggataaccataggcacgataattattttcccaaatcaatttaattttttctttgagttgattatcaacacgttcgtgttgactaggttgatatcttttccaatggtaataggtgctgcgcggtaatttcagtgccgaaagaataattgataagcggtgtcgcaataactgatcttctatgaagacaaggcaattaattcgtcctaatgctttcccagtaacaccgccgcagcttttaaaatttcgagttcctcctttaatcgctgattttccttttgaagttgtttgaattctttggacgttacttcagtaccgtcttctagctcaactgatttagcgcctttaacccagttatgaattgcggctggagaaacaccgtattcctcggaaagcgagcgaatagatcttttctcttcacgatgcatcttcacaatgctggctttaaaatcatcttgatatcgtttcattggaatgctcctatcttgttttattaattatggcacaactgttcagaaatttatgtaccaaatactaggataggagcagtaaattgcaagaacaagttagccagtcgttgaggacaatcccagaacaggccgttatcaaatagaagttgtggcgctagagagactactgggccatgcggcgaacgcgccgagcttcggcctcaaagttttgctggggtgtgcagtagccctgttgtttgcgaggcaactgattcaagcggtcttgcgtggcctgcacttgactagggctaatgtcatctagggacatgcccttagggaagtcctggcggatcatccggttatgtgcctcgttggtgccacggtcgcaggacgtgtaaggatgggcgtagaagatctcagtttccgtcccagcaaaagcagtatttaaggcggtgaactcgggtccgttgtcggctgtgatggtcttgatgcaagctccccattcgcgcttgattccacgcaatgcatagctcacagagtctgcatctcgtccttcgatcaagcggagaagttggcaacgggtcttgcgctcaatcagagtcaagatgacgctctccttgccattgcgtttaccgacaatggtatccatctcccagtgaccgaactgcctgcgtcgttcaacgaccttaggccgttcctcgatactgcggccagccaggcgcttagccttggtgtggtgctggtgagaggtcttccgcttagtcttctccaacaggtcgatatttcgaatctctaggcgttggtcgtcaatgtactggtacaaagtcgaggcacaaacaagctcttcaggagtaaacagcttgtgtcgcttggcatagccgattgaagcatccggcgaccatttgtcctgcttagctcgctgtacgtaccaggctaagaagacctgtacgctggcgaacttgtcaggacgatggcagctcaagcgtgcagtctcgtaacgtgcctgagcagcctctggcaggtattgtcgatggtagacgcgcttgccattactcttcttgacctgatctactgtacctcgcttgatttcattattaatggtctgcgggcagacgccaatttcagcagcaatccaacgattggacttcccagcttggcggaatccggccacttttccgcgctcgagtgatgttaagtgctgacctttttggcggtgtgtggtatcctgtttctgcatcaagatttttactagggggaatcggtttgaacgcaagtgagagtatttttctaacgcaagcggaaaatgataagtacgccttattaatggagattgttggtttaaaacgggatgagttgcctgttaaaaagcggattgaactatcgcgtaataatcagccgctcgttgaagatgtgaatctaaaacaagtagcaatgctattaaatcgcagttacggtagcttgtacaatatgtacatgagcattattggggacctaaaggaaattatcggaccggatgttgatgatattaaaaccttgttcagcgttccaacagatgcctatcactatttattagtgaataagtcagaagcgtttgattttatcaaaatcttactcaagggtgagaccgttacattccaagaattctgggaagcccatgatacgagtaaggcaacggcgctacgccatttaaaaggggtgcgcgacttaattcgctcatttgatatccgtatgtattatgatccacttcggttagaaggcgacgaaaataaaattcatttagtcttaacgatgttattctggatggcaaccgaagggcatacctggccctttgaagatgttaaacgagacgatgcacttaaggcgttcgatgttgcgattgatcggttccaattggaaaaacccaatattttgacccgtgaactaggggcgtattcaatcgttgtaacctatttccgattactacaaggtcacacggtttcaactgaactagatggcggttttatccgttatccagttcccaatatggtttctgaatatctaaaacagccctttgaagaccaagctttacggatcaagagcattcttgcacaaatgacccaagaagaagcgatggctgaatcattcaatatatatggtagattgtaaaattaatccgaacgctgttcggacaaaaaagatcagcttcctttaaaatggtgtttatcacaaacccatcttttaggagctgatcttttgtctagtataacctattccccaccagaataatctgtgggacagtcccagccctcaccctttagcttggcagctacagcttgttcaaatttatcttccgctatttaactagtcttcttttcttttttagttgtaactatttaccaaaacgccaccactttttaagtttaggttgtgactccggggtgctattttcaggttccggttgtttgtctgacgtcacttctttttcaccatcatcatgcggtgccatcgttaaggctttcaagtccttaatttctgccttgtattcttcgagcagttgtttgtcctgtaaggccaatctttgttgctggtctagtaatttatgtaactctttcttttcagattgaatttctgatactaaattgcgaaggaatttcacttcatcttgatcataaacagcatctttttcgttgtcgtcaatatcatctttatgttgatgttctttggttgatgaaccatttttaaacattgatttaatagtcttttggccgtcaacattaacgtaaacggtattaccttttgttgatgtaaattgacgtaaatcgattgacgtatctctttttatcttttgccatatggcctgctttgaaacgcccaattcatcagcaagttctcgaatcgtttttaaattttcactcatggtctatatcctgccttttaacgattggtagatactgttcaatcgattttttaagatacttagcaatattgtttttcgaatagtcatcttgtttatctcgaatatatgctaagtgttcttttacaccatttaatccacgtaactcttttaattcgtcataaagtggataaacatttttctgtagccctgacaaaatagccgtatccgtcaaatcaatgtatgacaacaagaaatgttccatcaacaattttgtatatggactcttcatagcttcatatacaagatctttttcactttgaaaatcaaaccagtattgtgtccgttccttgagctgacgattacgggcttcccaagctgtttcttctcgatttaaccctttgtagtaagcctgccggcttacaccgacaacggccaacagcgtagatattgcaccacgcttgccttgactgacctcattaattgcgaagtaagacagtcgatgttgtttactcaccccctgcgctggatttccagcaatttttttgcgaatgcctccacaagctctttgtctgcgagctgtgctttgagctgcctgatttcaagattggctttatcgagttcagtcagctcagcttgttctttgtgatggccacggttgtccacgagcgcctcatagccgccgtgattggccttgatcacccatgaacgtgcttgttgataagagacttggaagcgttcagcggcctctgtgtatgaatgattcagcttggtgacatactcgacaatttcaatgcgttcttccaaggttgttttacggctcatagtgggaacctgctttctggacggcgacgccgtcaaaggtttattcccattatacttgtttacccagtctacgacttgctgcgatccacgaagtccaaacttatttgcaagttcatcaaaggtgccttcgcctataagatatgcgtggactactttgagcttgagttccttcgaatagtgtttgtttttcttagcctcctttagaccattaattccatcacgggagtatcgatctcgccaacgctctagcgtcttacgatcaatgccatggcgattggccaccggacccagtccaatttttgattgggtcagttcatctaagattgttaatttctcgagtaccgtatgtttagatctgggcatacaaaaatccctccatagtcgtcagatgaattattgtatttcatctgacaaccataaagggattatcgcagtttaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgtctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaggcggtgtttagagccttagccgttctattaggggctttgatggcccatagaagtcgggtcttacgttctacgaatgtaaccagacatgatcgtgactcacttcgactagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgaccgcaattccgccttttgcgatctgcatcttgctgagctaattctggatcataaggtttaactcggtccaactcatagctaatcgtagctttggcgacgcctaaggcgtcagccattacttggtaagatttattcccctcattgaccagttgtgctagtgcgccacgttgaaaacgtgataaagtagatgtacccaaagtaatgaatgtttatagtgctttatattgttctttttttaagcgattgccatcatttcccaaagttcttcataggtcccatgtagtgctcttaattgggtatgagttccagattcgacaagctgccctttatctaagacaaatacctgatcacaatcttttgcaatggataagtgatgggcgatgaacagaattgttttattctctaagttcatcaaattttgaattatttgatgctctgatcgagtatctaaaccgctagttatttcatcgaggatgagaatttctgagttctttaacaacgctctcgccagagctaaacgctgtttctgaccacctgaaagattgctggcaccttcttcaataggagacttgaattgaaggggcagtccttcaatgtattcttttatctgagccatttcacatgcccaaagaatctgttcctccgtgggttgatagtctataccaaaaattaagttttcaaagatgctgccactaaaaaagaaggtttcttgtgatacatacccaatcttatttctcaaatcaattcttggaatatcttgaatagattttccttgaatttctatttcacctttttgagcagtatagaagttcacgaacaatttagctaaagtcgattttcctgatccactcattccaacgattgctactttctgatttgatttaattgaaaaggaaagatcatttagaacgttttcgtcgaatccatatgcaaaggataagtgctttacttcgattaatggctttttcgtaaacaattcaacattatccatttgttgactggttggttcgcccatcaattctcgatccagaaagaaaacttcatttagtcgatcgttagctactttagccgtttgaatctttatactccctatattggttggaattagctactaccattgtaagtgattgctttgggctttttaatttctgttcggattaattatagaatttgccaacttaaataaatgatgcttccaaggtgtcctggattcctttgaaccctcggtggatccgcttcagagacttctcgttataaacattaaactgagaaaccaggaagcgatccagtgaatcttccgttggaaattgttctttgtgatgggtggtgcgcttgagatgcttattaaagttctcaatcaggttagtggagtatagtgattgccggatagctggtggaaagtccatgaaagtgagtaaattcggcaatttcagcagtggtaattcccttggtatacaactgaatgaccgttgtttctaaattatcactgtaccgaccgtaggctggcaaggtatggttttcaaaccggccattgcgatctcgaggaatggttaagttaagttggccgtacttcgtatcaaatgagcgctcataactgccgttgcggttattaccagtgttaatcccagcgtatgagtagcgttcgtaacccaaaaactctgccaattcggtttgaagcagctggttaatcgcaatttcgaggtggtgacgaaaaacttcgtccaaatcttgcttttgggctagtgcagcgataatttctgtggtaagttcattcatggggaatgcctcctgtgatgttttctgtgattactaaatatcataagggaaggcattccctatttctatacaattcagaaatcttttatgcccaactcgttacgacaaagaattcaaacaaaacattatcaacctatataagcaaggcgaatcagctgcccaactggccagagaatatggcattggctattcaacagttcataagtggatccagggccaggccaaaactcaatccggtaaatcgccagacgaaatcaaagcgatggaaaagcgactggcttcgctgtctgaggagaacgaaatcctaaaaaaagccctgggcttccttgcgcagaagtaaccaatatctttgattacattcaccaagaaagccatcaccaccaggtaaccaagatgtgccgaatcctcggtgtttccagagctcagtattatcgttatcgatcccccaaaccttcaaaacgccgggccgaagatgcgggcttgaaacaacggattctgcggatctttgcggaatttaagcagcgatacggtgttatgaagatccaccatgaattgaatctggaacttcaaccactgcagcttcggtgcagtccacgacggatttcccggctcatgaaggaactggatagccactccgttaccgtcaataagtggaaagcggcttcggcttccaaaaccaaggttgaacagcgtcccaacttgcttaagcaggatttctcgaccactggtttaaatcaaaaatggaccgctgatatgacctatattcaaacgaagcgtaatggctggtgttacttatcaaccatcatggacctgcactcacgacggattatcggctattcgttctcaaactcataattaaaatcctgtaaaatggtgtttgcgaagacagccactggaggaaattaattatgagttcataccatcatcttaccatagaagaaagagaaaatatctatattatgagacacgacggtctctcaattaatattattgctgataagattcatagaagtccagcaaccatttcgagagaactgaagcgaaataattcaatatactcgccttctaaagctcaaagacgttataggaattgcaaaacaaactgcggccgtaaggccatcttaagtattgtcgaagcattaaaaattattaaacacttattcttagattttcaatggtcccctgaagaaatttctgccagattacgtttagaaaattctgatatcgctatcagccttaccaccatttataggggaatttacgcaggcttgtttgatgaagcaccgttaagccgtggtaatcgtggcgttatcagacagttacggcatcgcggtaaaactaggcattctaaaaattttaaagaaactcgcggtaaaattaggattacaaactcaatcaatgaacggcctgtaaaagctaataatcgcttagaaattggccattgggaactagatacaatagctggtaaaactggtcgttcttgcgtggttacaatggtcgatagaaaatctaggtatactctaattagtaaggctagcaagaaaagctctgaaccagttactagtgctcctatgtcaataaatggcattttattgatggaggtttagctcagttgggagagcgtctgccttacaagcagagggtcacaggttcgagccctgtaacctccattgagtcgttagctcagttggtagagcatctgacttttaatcagagggtcgacagttcgagcctgtcacgactcatcggccaagttacacgccaaaatgcgggtgtggcggaattggcagacgcgctagatttaggttctagtgtctatatagacgtgggggttcaagtcccttcacccgcattcaattgaatattcaatgaaagttatcttattatgccgacttagctcagtcggtagagcatctgatttgtaatcagagggtcgggcgttcgaatcgtctagtcggcattaagatgcggaagtagttcagtggtagaacatcaccttgccatggtgggggtcgcgggttcgaatcccgtcttccgctttcattatgattaagccggggtggcggaactggcagacgcacgggacttaaaatcccgcggtaggtgactaccgtaccggttcgattccggtcctcggcatcataatgaaaaatgcacccatagcgcaactggatagagtgtctgactacgaatcagaaggttgtaggttcgactcctactgggtgcatataacgggaaatagctcagcttggtagagcacctggtttgggaccagggggtcgcaggttcgaatcctgttttcccgatgcactaggccctgtcaagttgacaaatgaaataatataaagttgaatctgtctctatgcggcttcactccagtattcatctggggtgaggccgtttctttgtgctgagcggttgtggtgattgaaatattcgattccttcctcaaccagtcttacaagctcttcgcaagtctttgctagtggatggcgagccatccaccgtaacttgaattcgttccaccagcgctccatcggtgcgttgtcgtatggtgttcctggtcgagacatgctacgtgtgacgttgtaacgaccaagaaagttgttgaaggcaccagaggtgtaggctgatcctcgatcagtgtgaaccaatgggtggacgtcgccagaagcctcaaaggctcgttggaaaacctcgatttctgctgctgacgtttcagtagtgctcaaattgtaggacaacaaacgtcggccgtagagatcaaggacgccactcaagcgcaccttatacttattatttacgccgtaagtcagttccgttgaatcggacaaccagacctgattaggactgtcgacgtcgaagttctgattgagcacattgtcttgaatgtgctgttcgttctccttatgtcgactgtgcttcttgacccgaatttgacatgtcaagctgagctcccgcatcacacgacgtaccatcctgaaagtaacggggaagtcaattaggtcatcatgttgaatcatcaatccaaaccgatatttgtgaaactagcgtttcataagtatcggtttctttttggtagaaagcttcggctttcataatatggaaaaagctctccattgctgcattatctaaacatgttgctttgcgagacatactttgaaaaatgcgatgttctttcaagatatgagtccaatcttgatgctggtattgaaatccttgatctgagtggactgttgtccggtattttaaattcttagggattttcttaactgctcgattcaaaacagttgtagtaaattcaacagtagggtgtttactaacttgatggctgagaatttcacctgagaataaatcataaatacatgtgaaataggcgcgttcatcaattgtcttggttccccagcgaacttcagtaacgtctgttactagtttttgataaggacgatcagtgaagaaacgacggttgatcaagttcttagcaacggtgccaacattgcctctatatgaattatatttacgagtacgtttgttaaatgcagttgatagtaattgcagttctcgcattaagacaagtacttttttatgatttactaagatattcatacgatgtaattcaccagttacacgacgataaccgtacgctggatgattcttcttgattatttggatggtttgtttaacagattggtcagatgaaccgttcggttcatgactaataatgtattcatgttggaattagttactaccattgtaagtgattgctttgggctttttaatttctgttcggattaattatagaatttgccaattattaagaataatattaattttaatctagatttctatttggaagtacagcaactataaagcatagtctgtgatataataataaaagattagaaatgaaataaaacgcttgacagaagggttttgagggacgactatgagcagagcagagcagagcagagcagagcagagcagagcagagcagagcagggattacgtgctaatttagaatataacaacggtgttaaagctaacaccgctttttatgatgaacttaaaaataaactccccaatttttttacagcggacaaactcgacgagtttggcgctgtgaaagaattggggagttttgatttagaaaaatttaaagcgagtttaagtgagaataatattaatgaattgactagtggttaccagttagatttcattggtaagaactatgctaaaaaacaagcgggtgaacgaccaacaaccgtgattgtaccagataatgtgcataatgaaaaagcggagaataagagtagtaaaaatctattctttagtggtgataacttagaggttctacgacacctacagcagaattatgcgaattcggttgattttatttatattgatccaccctataatactggatcagatgggtttgtttatccctgatcataatcagtctgagtggttggcttattgattcgtttaaccattctagatctaatccctaattcacacatttgttgatagaccagacgctgactaacgtgaatatcagactgttgatttagtaagatcgttaatcgtgggtagccatacattggatatcttaaccaagccgttaacacttcttgtttaattaaatgccggcggcgttcagttctacttggctgccaatgtagataatcatagtaggttgagcgcggaattttgagtactgataagatacgcgtaatgcggtgcccagcaagtaaattagcgttgacgacttctaacacgagggcacgccctttaataattagctttttgccatgagcaccgccgctcgttttaaaatatcaagttcttcttttaaccgtttattttctttaatcagagcacgttcatttgatgatagcactttagtgttgttaggatcagcttgtttaatccacttagtgaccgttgaaacactgacgttgtattctttagccagtgagttggccgaacggccagtctgacttaagctaacaatcgattctttaaattcatttgaatatttaattgccataataaaaagctcctttatgatgtattatatcgaacagtttgtccgtaattccatcataggagccctttttgaatcttttaagaaattatagctgctaatgcagcaccagtccgagagtttttatcgtttaggctatcttttggatgaccttcaaaacaaacttgaccgccgaatttaccagcatcgggtcccatatcgactaaccaatcggctcgtgaaattaatttcagattatgttcaatcagaattaatgtattgcccttatcaaccaatccttcaaataaatcgatcaattgttgagtatcctgtaagtgcaatccggttgttggttcatctaagaaatagattcggccggtatgattcaattccattgctaacttaacacgttgcacttcaccaccagataaagtggtcatcgactggctaagattcaaataaccaagtccaacttggtggagtagactaacctttttgtagatatctggcacatctttgaaaaactctaaagtgtcgttgatagaaagatttagaacctcagaaatatctttgccatgataagtgtattgtagtgcttcttggctataacgtttccaaacatttataaaaaaagccaattactacagtaattgaccagccaataacaaccatggattcatttaaaagattgttaaaaagtttaacatatagggaaaaatttatcttgtgctacgacttaaaaagaaagaaactactgctacaacaactattgcgcctataattgacggaataatggccataccagctatatttggcccccaactgcctaaaatagcttcaccaatggatgagccaactaagccagcgataatattgctaatccagcccatagctgcgccccgattagtgatggcaccagcaattgcgccaataacagcaccaacaattaaaacccataaccaatgcataaaattcacttcctcttttttgaacaaacgttctataatgattacaaggataaatataaccttatcaagggtgtgatgcaaggaaaccatacgagcaaagctgttgaacaaattcacaatatttcctgtgcatgctatttatttcataaatgtttcaataataaaataggtcttactatgcccacgaggaccaacgactgtatctagttcaaaatcgccgatgcgcttacgttgattaatcatcatgggacgctgttcaattgatcgccccaaagattgattatatttggatcgttggtcaacgttacgccgttggcgtacgccatgttcaggtagatcattcaaggagaaaccaattctcccctgatttagccaattataaatagatttagtagctagtttaaattcgtgagcaatcattcctggtgaccagcttagacgtaaatggttgagaattttttgctttaactcatcgctcagcttagttttccgaccacatcgtgatcgcttgtattcggcatctgtttgtgctaattcagcctgataaggttgacatcgagataattcataagaaattgttgacggtgatcggttcagccgaacgcccatttggatattggacagccctagttcacaaaaggtttcgattttaattcgttcatcatgaatatgcgggtgtagtttagtggtaaaaccacagccttccaagctgttgtcgcgagtccgattctcgtcacccgcttttcatgggcctatagctcagctggttagagcgcacgcctgataagcgtgaggtcgatggttcgagtccatttaggcccattatctaaataatatggagaagtactcaagtggctgaagaggcgcccctgctaagggtgtaggtcgggaaactggcgcgagggttcaaatccctccttctccgttttgtatggcccgttggtcaagtggttaagacaccgccctttcacggcggtatcatgggttcaaatcccgtacgggtcattgtaacaatgttacattttatatgttttatggagaattacccaagtctggctgaagggaacggtcttgaaaaccgtcaggtgggttctgcccacgcgagagttcgaatctctcattctccttcagattttaaaaacgctttagagtatattaaataagccccaacattattgaatttaatagcctgtagctacgctacaagtgaaatacgatcactgttataccaacgaatatagttatcaattccggcgattgcttcatgaattgtcttaaaatcttggaaattaacgtattcacgtttcaaaattgaatgaaaactttcaattcgcgcgttatcgccgggctgaccctttcgggagtaagaatgcttgataccatacttcgataaagtgttttcaaataagtcacttgtgtattggcttcccatatcactatgaataatttgtggtttaactgcttgcgccatgacttgggtaataacgttagtcgctagttctttagtcatctgcgtattaagttggcaaaaagatggctactgatttagtcttaaagacccttgaaagcgcggttaaaaatcgaaccattactggggacctgattatctatacggatttaggatcacagtataccagcgatgattacaatcaacgtttaactgagctacatatccgccactcatacagccgtaagggttatccgtatgataatgcgccaatggaatcctttcacgcttccatcaaaaaggaatgtgtttatccagtgccggtctttgaagattatgaaactgccgctgccgtcctttttgaatatgtgcatgctttctacaacatgctttctacaataggaagagaattcatagtttactgggctaccagacccccttacaagttgaaattgcaatagagcaatcacagaattattaaaagcattacctcaaaacaagataaaaacaattaccccggataggggtaaagagttttcaaagcacagtcagattacaagtgaatttaagacagaattttattttcctaatccacatgcgccatggcagagaggcacaagtgagaatacaaatggtctaattcgagagtatatgcctaaaacagaggatatagatccgctagatgatgactatattcgtgaatttacagaaaagctaaataatcgacctagaaaatgtttaggttggaaaacaccatatgagattttttatcagaaagtgttgcacttaatttgacaattcaaaatacaaaaagccctaccgtcttaaacagaataaaaagtcatttatttcttgttgcgttcttaatggttggacgttgtaaggcatttaaaagccctctcctctcacaaaagcgatacatgattttgtttagtataccatataatcatgtattggagggcgatataaaaaaagaaccctattggaataggattccggatacacgtttttatacaatttcatgtattaatttatattttcaggtaataaattaatatttcgaataatgtaatatatattgctcctatgtcaataaatggcaatggcgcaggacagaatcgaactgccgacacatggagcttcaatccattgctctaccaactgagctactgagccattttgaaacggtcacaacgggactcgaacccgtgatctcctgcgtgacaggcaggcgtcctaaccagctagaccatgcgaccaaattgcgggagtagggtttgaacctacgaccttcgggttatgagcccgacgagctaccagactgctccatcccgcgataatataaattgtaacgtaagttacatgttataaatttaagttttttggcggtgtagctcagctggctagagcgtccggttcatacccgggaggtcgggggttcgatccccttcgccgctatttttcaaaaaacttggacctttagctcagttggttagagcagacggctcataaccgcccggtcgtaggttcgagtcctacaaggtccatcgtttggtgagattttgtaggtggttataatatttgatgactattgtcatcaatggaggataacgggatcgaaccgatgacctcctgcgtgcaaagcaggcgctctcccagctgagctaatcccccgtgttggtactatttaactcttagtacaatgggcctaaatggactcgaaccatcgacctcacgcttatcaggcgtgcgctctaaccagctgagctataggcccaaaaaacgtcctaattcaataataccatattgtgattcaagtgatactagcccactaaactcagtgccacggtccacagtaaagctgtgcaccggaccattaaaagtggttaggaacttagttagtgcttcattaacagtcgctgtcgtccgatcttttaaccggtatgcccaaaggaaccgtgatttgcgatcgattaaagttaataaaactgcctttcgaaaaaatctaaaatgctatcattatccaaagcaatttcatagatagtttgattactctcggttgtttcgatgattgtatccaaatcaatttgtaaagccttgaataggatatattcaagcactcgcttatcatagatatatttatctttaatatcgcggttcacgttgcctgtgtcgtattggtgtgccagtcgagtattttaagcggtcgctggttaatttggagtaacgtcgtcgttaaatcttgagcactaatgtgctcaaaacgagtccctttaggataaaaataacgtaaattccgattaaagcgttcattactaccacgttcagctggagtataagcatggcagtaataggtcttgtcgggaccatctggcaatggcaacatatttgggagactgagggtgctgatgccttatatcgttccaaaggacggcaaacaattatgtcagctgataaacaatcaaaaaaacggcaacaaacagagttagaacgtcttagagaagaaaatgaattgctacaaatcgagaatgaaatttgagatattaaaatgaagtgcggttttcggataagaagccttattcgttttcatccattttaaaacattcatcttaaatgagccatcaaatgttttttcgggtgataggacatctagtccttttgggccaaaggccttataacgttgaacccacgagacaacttgaagtgaacccccgatattggaccaaaatccaatatcgggggtttttatattgaccaaatattctaaaacattaaaaataaaagttgttcaggattatctaacgtcacccttaggttataaattaatagcgagaaaatatggtattaagagtaactcactcatgtaaaaattccttccttttgagagacgatttattcattataccctctcttaaaagttgtctcaggaatcagcttacatccatccaatgccaaagacctatcaagaactaatgaaattggttgaagcaggaatcgaatattttaatctggattgaagtcaatatttgagacagattttaagagacattcagaaccgcgtttaccttccacagctcaaataaatcattaatcgcgattaataacttatttgaaccctggaaagcattaaatcaggcggccatttggctcgtaagtgagttgtctcgtgggttcaacgttataaggcctttggcccaaaaagactggatgtcctatcacccaaaaaaacatttgatggctcatttaagatgaatgttttaaaatggatgaaaacgaataaggcttcttatccgaaaaccgttaagcaataacccgtcgggttactggattatagacactagctaggtaacaccaagtatggttaaggggaatgtacgtaatatcagtcaataaaataccagattgatcagttaactgcttaatcaagtttggtcgtcatacgtacttttggccataccaactatttttagaatttttactagtttgtgtttaagccttagctcttggataacttgcgcttgttgttttcttcttcctggactaaggctcttaatttttttaggtaacgtacttttggccataccaactatttttagaatttttactagtttgtgtttaagccttagctcttggatgacttgcgcttgttgttttcttcttcctggactaaggctcttaatttttttaggtagtagattgtaaaattaatccgaacgctgttcggacaaaaaagatcagcttcctttaaaatggtgtttaccacaaacccatcttttaggagctgatcttttgtctagtataacctattcccgcgcattttagaatcaagttagccactgtctcaaaattttttggacaataaaaaacatcaagaacagatatcctgtatcattgaagttcctacacaaacaatggaagaggatattgtagacaatatcctcttccattgtttgtgtaggaacttcaatgatacaggatatctgttcttgatgttttttattgtccaaaaaattttgagacagtggctaacttgattctaaaatgcgcgaaatattctaaaacattaaaaataaaagttgttcaggattatctaacgtcatccttaggttatgaattaatagcgagaaaatatggtattaagagtaactcactacttaatttatttgctagcgaaattgactttgcaaatatgttttgtgccccgaagggcgaccctacacatttggtttgtcgaaactttgttcagttttcaaag
